US011473147B2

(12) United States Patent
Perot et al.

(10) Patent No.: US 11,473,147 B2
(45) Date of Patent: Oct. 18, 2022

(54) METHOD FOR THE DIAGNOSIS OR PROGNOSIS, IN VITRO, OF TESTICULAR CANCER

(71) Applicant: BIOMERIEUX, Marcy-l'Etoile (FR)

(72) Inventors: Philippe Perot, Lyons (FR); François Mallet, Villeurbanne (FR); Nathalie Mugnier, Lyons (FR)

(73) Assignee: BIOMERIEUX, Marcy l'Etoile (FR)

( * ) Notice: Subject to any disclaimer, the term of this patent is extended or adjusted under 35 U.S.C. 154(b) by 353 days.

(21) Appl. No.: 14/367,673

(22) PCT Filed: Dec. 20, 2012

(86) PCT No.: PCT/FR2012/053017
§ 371 (c)(1),
(2) Date: Jun. 20, 2014

(87) PCT Pub. No.: WO2013/093356
PCT Pub. Date: Jun. 27, 2013

(65) Prior Publication Data
US 2015/0065369 A1    Mar. 5, 2015

(30) Foreign Application Priority Data
Dec. 20, 2011   (FR) .................... 1162071

(51) Int. Cl.
*C12Q 1/6886* (2018.01)
*C12Q 1/70* (2006.01)

(52) U.S. Cl.
CPC .......... *C12Q 1/6886* (2013.01); *C12Q 1/702* (2013.01); *C12Q 2600/118* (2013.01); *C12Q 2600/158* (2013.01)

(58) Field of Classification Search
CPC ................. C12Q 1/6886; C12Q 1/702; C12Q 2600/118; C12Q 2600/158
See application file for complete search history.

(56) References Cited

U.S. PATENT DOCUMENTS

| 5,858,723 A | 1/1999 | Mueller-Lantzsch et al. | |
|---|---|---|---|
| 2001/0053519 A1* | 12/2001 | Fodor | B01J 19/0046 435/6.11 |
| 2010/0136522 A1* | 6/2010 | Garcia | C07K 14/005 435/6.14 |
| 2015/0065368 A1* | 3/2015 | Perot | C12Q 1/6886 506/9 |

FOREIGN PATENT DOCUMENTS

| WO | 02/46477 A2 | 6/2002 | |
|---|---|---|---|
| WO | WO 0246477 A2 * | 6/2002 | ........... C07K 14/005 |
| WO | 2009/122053 A1 | 10/2009 | |

OTHER PUBLICATIONS

Stauffer (Cancer Immunity (2004) vol. 4, p. 2).*
Benner et al (Trends in Genetics (2001) vol. 17, pp. 414-418).*
Greenbaum et al (Genome Biology 2003, vol. 4, article 117, pp. 1-8).*
Cheung et al (Nature Genetics, 2003, vol. 33, pp. 422-425).*
Saito-Hisaminato et al. (DNA research (2002) vol. 9, pp. 35-45).*
Wu (Journal of Pathology, 2001, vol. 195, pp. 53-65).*
Perot et al. (PLOS One (2012) vol. 7, pp. e40194).*
Munroe et al (Molecular and Cellular Biology (1990) vol. 10, pp. 3441-3455).*
Subramanian et al (Retrovirology (2011) vol. 8, 90 (pp. 1-23)(e published Nov. 10, 2011).*
Ncbi blast ( http://blast.ncbi.nlm.nih.gov/Blast.cgi, May 24, 2016.*
Excel spreadsheet May 24, 2016.*
Morozova ( Ann Rev Genomics Hum Genet (2009) vol. 10, pp. 135-151).*
GenBank accession AP000776.5 (https://www.ncbi.nlm.nih.gov/nuccore/31745087, Jun. 14, 2003).*
Lower ( Proceedings National Academy of Science (1996) vol. 93, pp. 5177-5184).*
Gimenez (Nucleic Acids Research (2010)vol. 38, pp. 2229-2246).*
BLAST® » blastn suite-2sequences » RID-K4CY3C4J11N ( https://blast.ncbi.nlm.nih.gov/Blast.cgi, downloaded Jun. 26, 2018.*
Wada (Genes & Development (1998) vol. 12, pp. 343-356).*
GenBank Accession AF074086.2 (https://www.ncbi.nlm.nih.gov/nuccore/9558700?sat=46&satkey=24892331; (Mar. 11, 2002).*
Merriam Webster.com (https://www.merriam-webster.com/dictionary/suspect, downloaded May 20, 2020).*
Herbst (APMIS (1998) vol. 106), pp. 216-222).*
Ahn (Molecules and cells (2009) vol. 28, pp. 99-103).*
Stauffer (Cancer Immunity (2004) vol. 4, pp. 1-18).*
Pace (nucleic Acid research (2004) vol. 32, D50).*
Kovalskaya (virology (2006) vol. 346, pp. 373-378).*
Flockerzi, Aline, et al., "Expression Patterns of Transcribed Human Endogenous Retrovirus HERV-K(HML-2) Loci in Human Tissues and the Need for a HERV Transcriptome Project," BMC Genomics, Jul. 29, 2008, vol. 9, p. 1-17.
Herbst, Hermann, et al., "Expression of Human Endogenous Retrovirus K Elements in Germ Cell and Trophoblastic Tumors," American Journal of Pathology, Nov. 1996, vol. 149, No. 5, pp. 1727-1735.
Ono, Masao et al., "Nucleotide Sequence of Human Endogenous Retrovirus Genome Related to the Mouse Mammary Tumor Virus Genome," Journal of Virology, Nov. 1986, pp. 589-598.
"Human Endogenous Retrovirus HERV-K10," XP-002682133, Jun. 7, 1987, pp. 1-5.

(Continued)

*Primary Examiner* — Steven Pohnert
(74) *Attorney, Agent, or Firm* — Oliff PLC

(57) ABSTRACT

The subject matter of the present invention is a method for the diagnosis or prognosis, in vitro, of testicular cancer, which includes a step of detecting at least one expression product of at least one HERV nucleic acid sequence, the use of said nucleic acid sequences, which have been isolated, as a molecular marker or molecular markers, and a kit including at least one binding partner specific for at least one of the expression products of the HERV nucleic acid sequences.

19 Claims, 2 Drawing Sheets

Figure 1:
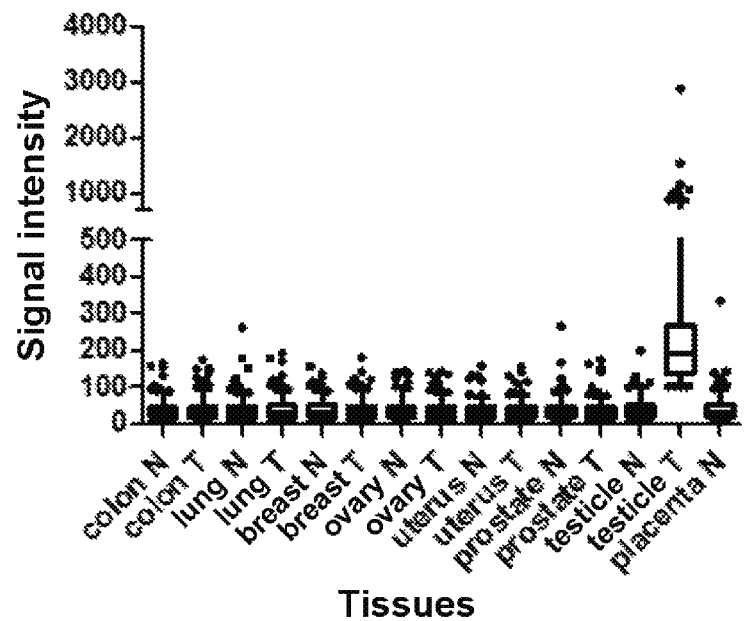

Specification includes a Sequence Listing.

(56) References Cited

OTHER PUBLICATIONS

Subramanian, Ravi P., "Identification, Characterization, and Comparative Genomic Distribution of the HERV-K (HML-2) Group of Human Endogenous Retroviruses," Retrovirology, 2011, vol. 8, No. 90, pp. 1-22.
"*Homo sapiens* Chromosome 19 Clone LLNLR-240E6, Complete Sequence," XP-002694826, Oct. 8, 1999, pp. 1-11.
"*Homo sapiens* BAC Clone RP11-453D22 From 2, Complete Sequence," XP-002694827, Feb. 14, 2002, pp. 1-48.
Paces, Jan, "HERVd: the Human Endogenous RetroViruses Database: Update," Nucleic Acids Research, 2004, vol. 32.
Kim, Heui-Soo, "Sequence Note: Sequence and Phylogeny of HERV-W pol Fragments," AIDS Research and Human Retroviruses, 2001, vol. 17, No. 17, pp. 1665-1671.
"*Homo sapiens* Pol Gene, HERV-W Family, Isolate: HWP2-3," XP-002699130, Aug. 29, 2001, p. 1.
Seifarth, Wolfgang, et al., "Comprehensive Analysis of Human Endogenous Retrovirus Transcriptional Activity in Human Tissues with a Retrovirus-Specific Microarray," Journal of Virology, 2005, vol. 79, No. 1, pp. 341-352.
Nickerson, Deborah A. et al., "DNA Sequence Diversity in a 9.7-kb Region of the Human Lipoprotein Lipase Gene," Nature America Inc., Jul. 19, 1998, pp. 233-240.
Navarro, Gonzalo et al., Flexible Pattern Matching in Strings, Summary, Cambridge University Press, 2002.
Irizarry, Rafael A. et al., "Exploration, Normalization, and Summaries of High Density Oligonucleotide Array Probe Level Data," Biostatistics, 2003, vol. 4, No. 2, pp. 249-264.
Johnson, W. Evan, et al., "Adjusting Batch Effects in Microarray Expression Data Using Empirical Bayes Methods," Biostatistics, 2007, vol. 8, No. 1, pp. 118-127.
Tusher, Virginia Goss, et al., "Significance Analysis of Microarrays Applied to the Ionizing Radiation Response," PNAS, Apr. 24, 2001, vol. 98, No. 9, pp. 5116-5121.
Storey, John D. et al., "Statistical Significance for Genomewide Studies," PNAS, Aug. 5, 2003, vol. 100, No. 16, pp. 9440-9445.
Jul. 2, 2013 Search Report issued in International Application No. PCT/FR2012/053017.
Herbst, H. et al., "Human Endogenous Retrovirus (HERV)-K Transcripts in Gonadoblastomas and Gonadoblastomas-Derived Germ Cell Tumours," Virchows Archive, 1999, vol. 434, pp. 11-15.
"*Homo sapiens* Isolate HML-2_11q22.1 Endogenous Virus HERV-K, Complete Sequence," XP-002682134, Nov. 21, 2011, pp. 1-3.

* cited by examiner

METHOD FOR THE DIAGNOSIS OR PROGNOSIS, IN VITRO, OF TESTICULAR CANCER

Endogenous retroviruses constitute the progeny of infectious retroviruses which have integrated, in their proviral form, into germ line cells and which have been transmitted via this means into the genome of the progeny of the host.

The sequencing of the human genome has made it possible to reveal the extremely high abundance of transposable elements or derivatives thereof. In fact, repeated sequences represent close to half the human genome and endogenous retroviruses and retrotransposons make up 8% of said genome, with the number of elements, at the current time, coming to more than 400 000.

The abundance of endogenous retroviral elements (ERVs) currently present in the human genome is the result of about 100 endogenizations which have successfully taken place during the course of the evolution of the human line. The various waives of endogenization are spread out over a period ranging from 2 to 90 million years before our era and have been followed by the expansion of the number of copies via phenomena of the "copy/paste" type with the possibility of the appearance of errors, resulting, starting from an ancestral provirus, in the formation of a family of HERVs, i.e. a set of elements which exhibit sequence homologies. The oldest elements, those of the HERV-L family, supposedly became integrated before the emergence of mammals. Two families, HERV-F and HERV-H, appeared during the period when the first primates were making their appearance. The HERV-FRD and HERV-K(HML-5) families, integrated 40 to 55 million years ago, are specific for higher primates. On the other hand, the HERV-W and HERV-E families, for example, became integrated 5 to 10 million years later, after the separation with New World monkeys, and are specific for the Catarrhini (Hominoids and Cercopithecidae).

The ERV sequences are represented on ail the chromosomes, with a varying density according to the families, and there is no correlation between the physical proximity of ERVs and their phylogenetic proximity.

For a long time, ERVs have been considered to be parasites or to foe simple DNA waste. Nevertheless, the impact of ERVs on the organism is not only limited to their past participation in modeling the genome or to deleterious recombinations which may still provide support.

The abundance and the structural complexity of ERVs makes analyses of their expression very complicated and often difficult to interpret. The detection of HERV expression may reflect the transcriptional activation of one or more loci within the same family. The activated locos or loci may in addition vary according to the tissue and/or the context.

The present inventors have now discovered and demonstrated that nucleic acid sequences corresponding to precisely identified loci of endogenous retroviral elements are associated with testicular cancer and that these sequences are molecular markers of the pathological condition. The sequences identified are either proviruses, i.e. sequences containing all or part of the gag, pol and env genes flanked in the 5' and 3' positions by long terminal repeats (LTRs), or all or part of the LTRs or of the genes isolated. The DNA sequences identified are respectively referenced as SEQ ID NO: 1 to 775 in the sequence listing, their chromosomal location is identified in the table below (NCBI 36/hg18), as are their expression, overexpression or underexpression represented by the "expression ratio" between cancer sample and normal sample. When the expression of the nucleic acid or the change in the expression of the nucleic acid is specific for testicular tissue, this information is indicated by the symbol "x" in the target tissue column. This signifies that, if an expression or a change in expression of the nucleic acid concerned is determined in a biological compartment other than testicular tissue, this represents, remotely, a signature of testicular cancer. The DMA sequences identified as being specific for testicular tissue are respectively referenced as SEQ ID NOs: 1, 2, 3, 4, 5, 7, 8, 9, 10, 11, 12, 13, 14, 15, 16, 17, 18, 19, 20, 21, 23, 24, 25, 26, 27, 29, 31, 32, 33, 34, 36, 38, 39, 40, 41, 42, 43, 44, 45, 46, 47, 50, 51, 52, 53, 57, 58, 59, 61, 63, 64, 65, 68, 70, 71, 72, 74, 75, 76, 77, 78, 79, 80, 83, 84, 85, 86, 87, 88, 89, 90, 91, 92, 94, 96, 97, 102, 104, 106, 107, 109, 110, 115, 116, 118, 121, 122, 123, 127, 132, 133, 136, 137, 142, 147, 148, 150, 159, 160, 162, 163, 164, 165, 166, 167, 170, 171, 175, 182, 187, 191, 198, 199, 201, 207, 210, 216, 219, 222, 224, 228, 230, 234, 244, 256, 263, 265, 266, 269, 271, 281, 286, 288, 291, 292, 296, 298, 304, 308, 333, 341, 347, 403, 429, 452, 485, 513, 556, 574 and 755 in the sequence listing. The DNA sequences identified as being not specific for testicular tissue are respectively referenced as SEQ ID NOs: 6, 22, 28, 30, 35, 37, 48, 49, 54, 55, 56, 60, 62, 66, 67, 69, 73, 81, 82, 93, 95, 98, 99, 100, 101, 103, 105, 108, 111, 112, 113, 114, 117, 119, 120, 124, 223, 126, 128, 129, 130, 131, 134, 135, 138, 139, 140, 141, 143, 144, 145, 146, 149, 151, 152, 153, 154, 155, 156, 157, 158, 161, 168, 169, 172, 173, 174, 176, 177, 178, 179, 180, 181, 183, 184, 185, 186, 188, 189, 190, 192, 193, 194, 195, 196, 197, 200, 202, 203, 204, 205, 206, 208, 209, 211, 212, 213, 214, 215, 217, 218, 220, 221, 223, 225, 226, 227, 229, 231, 232, 233, 235, 236, 237, 238, 239, 240, 241, 242, 243, 245, 246, 247, 248, 249, 250, 251, 252, 253, 254, 255, 257, 258, 259, 260, 261, 262, 264, 267, 268, 270, 272, 273, 274, 275, 276, 277, 278, 279, 280, 282, 283, 284, 285, 287, 289, 290, 293, 294, 295, 297, 299, 300, 301, 302, 303, 305, 306, 307, 309, 310, 311, 312, 313, 314, 315, 316, 317, 318, 319, 320, 321, 322, 323, 324, 325, 326, 327, 328, 329, 330, 331, 332, 334, 335, 336, 337, 338, 339, 340, 342, 343, 344, 345, 346, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 888, 389, 890, 391, 392, 393, 394, 895, 396, 897, 398, 399, 400, 401, 402, 404, 405, 406, 407, 408, 409, 410, 411, 412, 413, 414, 415, 416, 417, 418, 419, 420, 421, 422, 423, 424, 425, 426, 427, 428, 430, 431, 432, 433, 434, 435, 436, 437, 438, 439, 440, 441, 442, 443, 444, 445, 446, 447, 448, 449, 450, 451, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 486, 487, 488, 489, 490, 491, 492, 493, 494, 495, 496, 497, 498, 499, 500, 501, 502, 503, 504, 505, 506, 507, 508, 509, 510, 511, 512, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 357, 558, 559, 560, 561, 562, 563, 564, 565, 566, 567, 568, 569, 570, 571, 572, 573, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 698, 699, 700, 701, 702, 703, 704, 705, 706, 707, 708, 709, 710, 711, 712, 713, 714, 715, 716, 717, 718, 719, 720, 721, 722, 723, 724, 725, 726, 727, 728, 729, 730, 731, 732, 733, 734, 735, 736, 737, 738, 739, 740, 741, 742, 743, 744, 745, 746, 747, 748, 749, 750, 751, 752, 753, 754, 756, 757, 758, 759, 760, 761, 762, 763, 764, 765, 766, 767, 768, 769, 770, 771, 772, 773, 774 and 775 in the sequence listing.

TABLE

| SEQ ID NO: | Chromosomal location | Target tissue | Cancer/normal expression ratio |
|---|---|---|---|
| 1 | (+) chr 11: 101071004- | x | 193.7 |
| 2 | (−) chr 7: 113806379- | x | 138.9 |
| 3 | (+) chr 22: 17312687-17315361 | x | 106.0 |
| 4 | (−) chr 3: 114225814- | x | 102.4 |
| 5 | (−) chr 12: 10378984-10382509 | x | 85.5 |
| 6 | (+) chr 4: 3980100-3985736 |  | 40.7 |
| 7 | (+) chr 7: 82926920-82932637 | x | 40.2 |
| 8 | (+) chr 19: 59026470-59032416 | x | 25.8 |
| 9 | (−) chr 21: 19046925-19054737 | x | 25.0 |
| 10 | (+) chr 22: 15472270-15476039 | x | 24.0 |
| 11 | (+) chr 13: 50642003-50645550 | x | 19.4 |
| 12 | (+) chr 7: 138796751- | x | 19.2 |
| 13 | (+) chr 6: 123203066- | x | 18.8 |
| 14 | (+) chr 7: 26277620-26277795 | x | 13.0 |
| 15 | (−) chr 6: 78483381-78492802 | x | 16.5 |
| 16 | (+) chr 4: 115184990- | x | 15.2 |
| 17 | (+) chr 4: 167342466- | x | 14.2 |
| 18 | (+) chr 10: 30806145-30806207 | x | 13.5 |
| 19 | (−) chr 5: 147229590- | x | 13.4 |
| 20 | (+) chr 3: 149764167- | x | 11.8 |
| 21 | (−) chr X: 78969339-78970117 | x | 11.3 |
| 22 | (+) chr 2: 78046215-78051486 |  | 10.7 |
| 23 | (−) chr 5: 30522517-30531962 | x | 10.2 |
| 24 | (+) chr X: 113169528- | x | 10.0 |
| 25 | (−) chr 21: 18857493-18863833 | x | 9.7 |
| 26 | (+) chr 2: 75952324-75960132 | x | 9.6 |
| 27 | (−) chr 21: 18226907-18227874 | x | 9.5 |
| 28 | (+) chr 12: 25207414-25213718 |  | 9.3 |
| 29 | (+) chr 19: 5499587-5504223 | x | 9.3 |
| 30 | (+) chr X: 17373751-17374707 |  | −9.0 |
| 31 | (−) chr 5: 156019973- | x | 9.0 |
| 32 | (+) chr 3: 145935886- |  | 8.8 |
| 33 | (+) chr 12: 69166007-69166696 | x | 8.7 |
| 34 | (+) chr X: 120317777- | x | 8.6 |
| 35 | (−) chr 4: 92495874-92498563 |  | −8.4 |
| 36 | (−) chr 12: 57007509-57016965 | x | 8.2 |
| 37 | (+) chr 16: 84869202-84872386 |  | 7.9 |
| 38 | (+) chr 16: 18032452-18032995 | x | 7.6 |
| 39 | (+) chr 3: 12690614-12691581 | x | 7.5 |
| 40 | (+) chr 2: 201711970- | x | 7.5 |
| 41 | (+) chr X: 23366477-23366606 | x | 7.4 |
| 42 | (−) chr 3: 193128505- | x | 7.2 |
| 43 | (−) chr 19: 23000212-23006873 |  | 7.2 |
| 44 | (−) chr X: 23587921-23588870 | x | 6.9 |
| 45 | (+) chr X: 32817503-32817625 | x | 6.8 |
| 46 | (+) chr 5: 103549321- | x | 6.7 |
| 47 | (+) chr 19: 20978038-20978332 | x | 6.6 |
| 48 | (+) chr 1: 204107496- |  | 6.5 |
| 49 | (+) chr 6: 38501905-38502660 |  | 6.5 |
| 50 | (−) chr 12: 94755971-94756432 | x | 6.5 |
| 51 | (+) chr X: 113023373- | x | 6.3 |
| 52 | (+) chr 5: 147224419- | x | 6.3 |
| 53 | (+) chr 6: 160135759- |  | 6.2 |
| 54 | (+) chr X: 23085050-23085831 |  | 6.1 |
| 55 | (+) chr 4: 16585555-16586042 |  | 6.1 |
| 56 | (−) chr 8: 138907724- |  | 5.8 |
| 57 | (−) chr 4: 13780668-13786698 | x | 5.8 |
| 58 | (+) chr 2: 215430449- | x | 5.8 |
| 59 | (+) chr 10: 92044720-92050459 | x | 5.6 |
| 60 | (−) chr 1: 205981124- |  | 5.6 |
| 61 | (+) chr 1: 191122168- |  | 5.5 |
| 62 | (+) chr 3: 37222224-37226355 |  | 5.5 |
| 63 | (+) chr 12: 3997968-4003123 | x | 5.4 |
| 64 | (−) chr X: 102902741- | x | 5.4 |
| 65 | (−) chr 7: 95825597-95826369 | x | 5.4 |
| 66 | (+) chr 19: 20440977-20441945 |  | 5.3 |
| 67 | (+) chr 14: 50429630-50433350 |  | 5.3 |
| 68 | (−) chr 17: 50443885-50450853 | x | 5.1 |
| 69 | (+) chr 11: 110428574- |  | −5.1 |
| 70 | (−) chr 5: 119558433- | x | 5.0 |
| 71 | (+) chr 1: 13759923-13763994 | x | 5.0 |
| 72 | (+) chr 12: 8848742-8854441 | x | 5.0 |
| 73 | (−) chr 14: 45033906-45038685 |  | 4.9 |
| 74 | (+) chr 9: 46471248-46471427 | x | 4.9 |
| 75 | (−) chr 11: 118099606- | x | 4.9 |
| 76 | (+) chr 15: 81168183-81174208 | x | 4.8 |
| 77 | (+) chr 8: 20179794-20180490 | x | 4.8 |
| 78 | (−) chr 5: 158726775- | x | 4.8 |
| 79 | (+) chr 12: 12102673-12108276 | x | −4.8 |
| 80 | (−) chr 4: 89076096-89077723 | x | 4.7 |
| 81 | (−) chr 16: 63823420-63826753 |  | 4.7 |
| 82 | (−) chr 1: 78221168-78222109 |  | 4.7 |
| 83 | (−) chr X: 102898629- |  | 4.7 |
| 84 | (−) chr X: 114680889- | x | 4.7 |
| 85 | (+) chr 15: 33318122-33323330 | x | 4.6 |
| 86 | (+) chr 7: 29791133-29794522 | x | 4.6 |
| 87 | (−) chr 3: 54643549-54649271 | x | 4.6 |
| 88 | (+) chr 6: 123199111- |  | 4.5 |
| 89 | (+) chr 9: 46471248-46471450 | x | 4.5 |
| 90 | (−) chr 11: 107158297- | x | −4.5 |
| 91 | (+) chr 3: 151801266- | x | 4.5 |
| 92 | (+) chr 13: 58985585-58985820 | x | 4.5 |
| 93 | (−) chr 11: 27607193-27613049 |  | 4.4 |
| 94 | (−) chr 7: 64362583-64363481 | x | 4.4 |
| 95 | (+) chr 14: 54561018-54561971 |  | 4.3 |
| 96 | (−) chr 1: 208351056- | x | 4.3 |
| 97 | (+) chr 7: 124686118- | x | 4.3 |
| 98 | (−) chr 14: 34189253-34193853 |  | −4.3 |
| 99 | (−) chr 4: 34697190-34700272 |  | −4.3 |
| 100 | (−) chr X: 79923327-79923769 |  | 4.2 |
| 101 | (+) chr 1: 70826708-70832264 |  | 4.2 |
| 102 | (+) chr 9: 46471248-46471450 | x | 4.1 |
| 103 | (−) chr 1: 110196377- |  | 4.1 |
| 104 | (−) chr 1: 15334421-15335379 | x | 4.1 |
| 105 | (−) chr 19: 20059494-20068590 |  | 4.1 |
| 106 | (+) chr 8: 48017702-48018142 | x | −4.0 |
| 107 | (+) chr 1: 144830619- | x | 4.0 |
| 108 | (+) chr 8: 105367316- |  | 3.9 |
| 109 | (−) chr 5: 76211738-76218598 | x | 3.9 |
| 110 | (−) chr 7: 154870513- | x | 3.9 |
| 111 | (+) chr 16: 55266229-55266680 |  | 3.9 |
| 112 | (+) chr 5: 76276534-76277531 |  | 3.9 |
| 113 | (−) chr 10: 6711545-6717509 |  | 3.9 |
| 114 | (+) chr 14: 49582825-49583215 |  | 3.9 |
| 115 | (−) chr 2: 138747205- | x | −3.9 |
| 116 | (+) chr 19: 60210007-60215603 | x | 3.9 |
| 117 | (−) chr 3: 172018098- |  | −3.8 |
| 118 | (+) chr 21: 17186401-17192433 | x | −3.8 |
| 119 | (−) chr 1: 111703869- |  | 3.8 |
| 120 | (−) chr 19: 32820338-32829058 |  | 3.8 |
| 121 | (+) chr 2: 77168875-77174664 | x | 3.6 |
| 122 | (+) chr 16: 8093804-8094296 | x | 3.8 |
| 123 | (+) chr 7: 24402389-24405964 | x | 3.8 |
| 124 | (−) chr 12: 102140022- |  | 3.8 |
| 125 | (−) chr X: 136823348- |  | 3.8 |
| 126 | (+) chr 1: 245338266- |  | −3.7 |
| 127 | (+) chr 11: 81194910-81201371 | x | −3.7 |
| 128 | (+) chr 15: 72433538-72439180 |  | −3.7 |
| 129 | (−) chr 3: 17751940-17752704 |  | 3.7 |
| 130 | (−) chr 15: 56912833-56913787 |  | 3.7 |
| 131 | (+) chr 11: 132231482- |  | −3.7 |
| 132 | (−) chr 12: 71389051-71394358 | x | −3.7 |
| 133 | (+) chr 16: 54225830-54226967 | x | −3.7 |
| 134 | (−) chr 10: 101570559- |  | 3.6 |
| 135 | (−) chr 10: 101571639- |  | 3.6 |
| 136 | (−) chr 4: 132945339- | x | 3.6 |
| 137 | (−) chr 22: 37782215-37788928 | x | −3.6 |
| 138 | (−) chr 2: 215413351- |  | 3.6 |
| 139 | (+) chr 16: 20680398-20681069 |  | −3.6 |
| 140 | (+) chr 2: 66328107-66330157 |  | −3.5 |
| 141 | (+) chr 13: 49071153-49072127 |  | 3.5 |
| 142 | (+) chr 7: 23794522-29798444 | x | 3.5 |

TABLE-continued

| SEQ ID NO: | Chromosomal location | Target tissue | Cancer/normal expression ratio |
|---|---|---|---|
| 143 | (+) chr 5: 110309293- | | −3.5 |
| 144 | (+) chr 7: 93107183-93112802 | | 3.5 |
| 145 | (+) chr 14: 99907955-99908356 | | 3.4 |
| 146 | (−) chr X: 93122712-93123534 | | 3.4 |
| 147 | (+) chr 8: 72739454-72745239 | x | 3.4 |
| 148 | (−) chr 5: 135912105- | x | −3.4 |
| 149 | (−) chr 1: 144779633- | | 3.4 |
| 150 | (+) chr 19: 46384319-46384717 | x | 3.3 |
| 151 | (−) chr 5: 98116139-98116552 | | 3.3 |
| 152 | (−) chr 1: 144779633- | | 3.3 |
| 153 | (+) chr 6: 131658190- | | 3.3 |
| 154 | (+) chr 14: 79939581-79940292 | | −3.3 |
| 155 | (+) chr 13: 61603944-61604298 | | 3.3 |
| 156 | (−) chr 17: 25945592-25949024 | | 3.2 |
| 157 | (−) chr 2: 231673651- | | 3.2 |
| 158 | (−) chr 2: 157905798- | | −3.2 |
| 159 | (−) chr 12: 66446853-66452393 | x | 3.2 |
| 160 | (+) chr 1: 113171325- | x | 3.2 |
| 161 | (+) chr 18: 46153554-46153955 | | 3.2 |
| 162 | (+) chr 2: 175898117- | x | 3.2 |
| 163 | (+) chr 11: 71130355-71138120 | x | −3.2 |
| 164 | (−) chr 2: 179624557- | x | −3.2 |
| 165 | (+) chr 14: 46643150-46647720 | x | 3.2 |
| 166 | (+) chr 2: 100252931- | x | −3.2 |
| 167 | (+) chr 11: 74429737-74430044 | x | −3.1 |
| 168 | (−) chr 14: 30785319-30790095 | | 3.1 |
| 169 | (+) chr 1: 173018447- | | 3.1 |
| 170 | (+) chr 3: 177027967- | x | −3.1 |
| 171 | (+) chr 1: 155690148- | x | 3.1 |
| 172 | (+) chr 4: 81599488-81599822 | | −3.1 |
| 173 | (−) chr 3: 130032422- | | 3.1 |
| 174 | (−) chr 12: 58003234-58009034 | | −3.1 |
| 175 | (+) chr 2: 111153345- | x | −3.1 |
| 176 | (+) chr 2: 71238414-71246247 | | 3.1 |
| 177 | (+) chr 1: 146832410- | | 3.1 |
| 178 | (−) chr 8: 58274716-58275677 | | 3.1 |
| 179 | (−) chr 3: 178866314- | | −3.1 |
| 180 | (−) chr 16: 58106314-58114369 | | 3.1 |
| 181 | (+) chr 6: 26107438-26108404 | | 3.1 |
| 182 | (+) chr 8: 144700887- | x | −3.1 |
| 183 | (−) chr X: 99928263-99933509 | | 3.1 |
| 184 | (−) chr Y: 20315639-20316390 | | −3.0 |
| 185 | (+) chr 2: 188084458- | | −3.0 |
| 186 | (−) chr 1: 94806343-94810970 | | 3.0 |
| 187 | (+) chr 1: 220188227- | x | 3.0 |
| 188 | (+) chr 17: 7905950-7906340 | | 3.0 |
| 189 | (−) chr 3: 130842785- | | 3.0 |
| 190 | (−) chr 1: 104478884- | | 3.0 |
| 191 | (−) chr 2: 188130911- | x | 3.0 |
| 192 | (+) chr Y: 16393469-16394311 | | −3.0 |
| 193 | (−) chr 3: 192866741- | | 2.9 |
| 194 | (−) chr 9: 90136987-90137726 | | 2.9 |
| 195 | (+) chr 6: 152853219- | | −2.9 |
| 196 | (+) chr 1: 55136163-55141845 | | 2.9 |
| 197 | (−) chr 3: 101474028- | | 2.9 |
| 198 | (−) chr 17: 25940325-25940380 | x | 2.9 |
| 199 | (+) chr 1: 144830619- | x | 2.9 |
| 200 | (−) chr 9: 84506297-84511021 | | 2.9 |
| 201 | (+) chr 19: 42503530-42504075 | x | 2.9 |
| 202 | (+) chr 4: 93411664-93417822 | | 2.9 |
| 203 | (+) chr 5: 92818136-92819135 | | −2.9 |
| 204 | (−) chr Y: 13388258-13388740 | | −2.9 |
| 205 | (+) chr 1: 171710187- | | −2.9 |
| 206 | (+) chr 2: 188606470- | | 2.8 |
| 207 | (+) chr 15: 60297998-60298452 | x | −2.8 |
| 208 | (−) chr 7: 5033421-5033757 | | 2.8 |
| 209 | (+) chr 4: 11264289-11269976 | | 2.8 |
| 210 | (+) chr X: 120305429- | x | 2.8 |
| 211 | (−) chr 7: 65107106-65110228 | | −2.8 |
| 212 | (−) chr 1: 20229120-20230095 | | 2.8 |
| 213 | (+) chr 4: 9179016-9179946 | | 2.8 |
| 214 | (+) chr 7: 22709502-22713805 | | 2.8 |
| 215 | (−) chr X: 67121911-67122334 | | 2.8 |
| 216 | (+) chr Y: 25287606-25288274 | x | −2.8 |
| 217 | (+) chr 7: 141097395- | | 2.8 |
| 218 | (+) chr 4: 54581003-54585874 | | −2.8 |
| 219 | (+) chr 7: 20552857-20557849 | x | 2.7 |
| 220 | (−) chr 6: 164993163- | | 2.7 |
| 221 | (+) chr 12: 28874497-28874581 | | 2.7 |
| 222 | (+) chr 7: 27282235-27283015 | x | 2.7 |
| 223 | (−) chr 9: 101942283- | | −2.7 |
| 224 | (−) chr X: 82404105-82404430 | x | 2.7 |
| 225 | (−) chr 11: 29951301-29951741 | | −2.7 |
| 226 | (+) chr 3: 127065283- | | 2.7 |
| 227 | (−) chr X: 152018946- | | −2.7 |
| 228 | (−) chr 18: 48666885-48667023 | x | −2.7 |
| 229 | (−) chr 1: 216834364- | | 2.7 |
| 230 | (−) chr 19: 51396736-51398483 | x | 2.7 |
| 231 | (+) chr 20: 32178411-32188045 | | −2.7 |
| 232 | (−) chr 12: 42629153-42829836 | | −2.7 |
| 233 | (+) chr 19: 63026807-63027775 | | 2.7 |
| 234 | (−) chr X: 5349700-5350270 | x | −2.7 |
| 235 | (−) chr 6: 24784895-24791307 | | 2.7 |
| 236 | (+) chr 4: 121134267- | | 2.7 |
| 237 | (+) chr 20: 23693465-23693815 | | 2.7 |
| 238 | (+) chr 5: 43093994-43094958 | | −2.7 |
| 239 | (+) chr 3: 40577391-40583175 | | 2.7 |
| 240 | (+) chr 12: 103861163- | | −2.7 |
| 241 | (+) chr 4: 166136290- | | 2.7 |
| 242 | (−) chr 11: 130128601- | | 2.6 |
| 243 | (+) chr X: 75266588-75267304 | | 2.6 |
| 244 | (−) chr 12: 41009849-41011163 | x | −2.6 |
| 245 | (−) chr 6: 114850158- | | −2.6 |
| 246 | (+) chr 3: 95139589-95145594 | | 2.6 |
| 247 | (+) chr 15: 45281613-45282311 | | 2.6 |
| 248 | (+) chr Y: 23653861-23654529 | | −2.6 |
| 249 | (+) chr 7: 20126857-20130993 | | 2.6 |
| 250 | (−) chr 1: 196365449- | | −2.6 |
| 251 | (+) chr 12: 39063705-39069607 | | 2.6 |
| 252 | (−) chr 13: 55584544-55586741 | | 2.6 |
| 253 | (−) chr 11: 67377518-67381008 | | 2.6 |
| 254 | (+) chr 4: 12071317-12071602 | | −2.5 |
| 255 | (+) chr 12: 87285946-87289889 | | −2.5 |
| 256 | (+) chr 9: 46471248-46471450 | x | 2.5 |
| 257 | (−) chr 12: 53400549-53401196 | | 2.5 |
| 258 | (−) chr 1: 113164281- | | 2.5 |
| 259 | (−) chr 2: 116652845- | | −2.5 |
| 260 | (−) chr 3: 154426628- | | −2.5 |
| 261 | (+) chr 3: 131260635- | | −2.5 |
| 262 | (−) chr 5: 145180750- | | 2.5 |
| 263 | (−) chr 2: 194703669- | x | −2.5 |
| 264 | (−) chr 5: 9051484-9054961 | | 2.5 |
| 265 | (−) chr 19: 57533845-57534797 | x | −2.5 |
| 266 | (+) chr 19: 336099-338637 | x | 2.5 |
| 267 | (+) chr 7: 72450571-72452057 | | −2.5 |
| 268 | (+) chr 4: 5645053-5645489 | | −2.5 |
| 269 | (+) chr 3: 17554579-17555183 | x | 2.5 |
| 270 | (+) chr 20: 12268915-12274587 | | 2.5 |
| 271 | (−) chr 17: 54987919-54988041 | x | 2.5 |
| 272 | (−) chr 17: 75846553-75846938 | | 2.4 |
| 273 | (−) chr 7: 158057001- | | −2.4 |
| 274 | (+) chr 7: 106257400- | | −2.4 |
| 275 | (−) chr 7: 145572005- | | 2.4 |
| 276 | (+) chr 11: 38579715-38585376 | | −2.4 |
| 277 | (−) chr X: 1978384-1979326 | | −2.4 |
| 278 | (−) chr 14: 105484495- | | −2.4 |
| 279 | (+) chr 11: 81158632-81159096 | | −2.4 |
| 280 | (+) chr 19: 58554156-58559856 | | 2.4 |
| 281 | (+) chr 3: 32084437-32092998 | x | −2.4 |
| 282 | (−) chr X: 16107244-16112478 | | 2.4 |
| 283 | (−) chr 2: 195907646- | | 2.4 |
| 284 | (−) chr 22: 23356413-23357378 | | −2.4 |
| 285 | (−) chr 14: 83497676-83498094 | | −2.4 |
| 286 | (−) chr X: 16144919-16150301 | x | −2.4 |
| 287 | (+) chr 2: 198151379- | | 2.4 |
| 288 | (+) chr 3: 192859268- | x | 2.4 |
| 289 | (+) chr 9: 22648524-22654061 | | −2.4 |
| 290 | (+) chr 7: 100274888- | | 2.4 |
| 291 | (+) chr 5: 24033176-24033667 | x | 2.4 |
| 292 | (−) chr 15: 93221236-93221380 | x | −2.4 |
| 293 | (−) chr 4: 93579126-93584828 | | 2.4 |
| 294 | (−) chr 1: 79934615-79940335 | | 2.4 |

TABLE-continued

| SEQ ID NO: | Chromosomal location | Target tissue | Cancer/normal expression ratio |
|---|---|---|---|
| 295 | (−) chr 1: 20280815-20281721 | | −2.4 |
| 296 | (−) chr 4: 180324622- | x | 2.4 |
| 297 | (−) chr 3: 58397972-58398349 | | 2.4 |
| 298 | (+) chr 13: 50645550-50647415 | x | 2.4 |
| 299 | (+) chr 8: 86338777-86339467 | | 2.3 |
| 300 | (−) chr 9: 29178033-29178600 | | 2.3 |
| 301 | (+) chr 19: 23052386-23053407 | | 2.3 |
| 302 | (+) chr 12: 101073296- | | −2.3 |
| 303 | (−) chr 7: 79651365-79652053 | | −2.3 |
| 304 | (+) chr 13: 24063731-24064668 | x | 2.3 |
| 305 | (−) chr 22: 37122490-37122813 | | 2.3 |
| 306 | (−) chr 6: 66439380-66440579 | | 2.3 |
| 307 | (+) chr 12: 94666771-94672799 | | −2.3 |
| 308 | (−) chr 13: 42512680-42513645 | x | 2.3 |
| 309 | (−) chr 8: 120956604- | | 2.3 |
| 310 | (−) chr 19: 42435136-42435718 | | 2.3 |
| 311 | (+) chr 8: 115363103- | | 2.3 |
| 312 | (+) chr 3: 78353823-78354204 | | 2.3 |
| 313 | (+) chr 8: 113277279- | | 2.3 |
| 314 | (−) chr 12: 84386849-84387812 | | −2.3 |
| 315 | (−) chr 3: 100178327- | | −2.3 |
| 316 | (+) chr 7: 35702274-35703153 | | 2.3 |
| 317 | (+) chr 10: 98482752-98486365 | | 2.3 |
| 318 | (−) chr 20: 15875323-15876306 | | −2.3 |
| 319 | (+) chr 2: 231645891- | | 2.3 |
| 320 | (−) chr 3: 130037918- | | 2.3 |
| 321 | (−) chr 1: 226879232- | | −2.3 |
| 322 | (−) chr 4: 100244913- | | −2.3 |
| 323 | (+) chr 1: 45574613-45575048 | | −2.3 |
| 324 | (−) chr X: 15473186-15473881 | | −2.2 |
| 325 | (+) chr 20: 825581-830240 | | −2.2 |
| 326 | (+) chr 9: 42473748-42474722 | | −2.2 |
| 327 | (+) chr 1: 227376628- | | −2.2 |
| 328 | (−) chr 10: 58449288-58449864 | | −2.2 |
| 329 | (+) chr 10: 111312507- | | −2.2 |
| 330 | (+) chr X: 119059748- | | −2.2 |
| 331 | (+) chr 1: 237429952- | | −2.2 |
| 332 | (+) chr Y: 4283432-4289271 | | 2.2 |
| 333 | (+) chr 13: 54525767-54533878 | x | 2.2 |
| 334 | (+) chr 7: 92862465-92866875 | | 2.2 |
| 335 | (−) chr 4: 5101984-5102366 | | 2.2 |
| 336 | (−) chr 10: 20449793-20453869 | | −2.2 |
| 337 | (−) chr 3: 127001763- | | 2.2 |
| 338 | (−) chr 2: 35515491-35521157 | | −2.2 |
| 339 | (−) chr 5: 12716708-12721442 | | 2.2 |
| 340 | (−) chr 1: 204120906- | | 2.2 |
| 341 | (+) chr X: 30031651-30037293 | x | −2.2 |
| 342 | (+) chr 8: 116896352- | | 2.2 |
| 343 | (−) chr 3: 171872658- | | −2.2 |
| 344 | (+) chr 2: 142963716- | | 2.2 |
| 345 | (−) chr 19: 41338217-41343765 | | −2.2 |
| 346 | (−) chr 5: 81601427-81604174 | | −2.1 |
| 347 | (−) chr 16: 14637505-14638479 | x | 2.1 |
| 348 | (−) chr 1: 82866215-82866932 | | −2.1 |
| 349 | (+) chr 21: 41248565-41252290 | | 2.1 |
| 350 | (+) chr 3: 8130557-8130971 | | −2.1 |
| 351 | (−) chr 2: 51343677-51344040 | | 2.1 |
| 352 | (+) chr 20: 43821380-43827293 | | 2.1 |
| 353 | (−) chr 5: 43551976-43552045 | | −2.1 |
| 354 | (−) chr 2: 193079050- | | 2.1 |
| 355 | (+) chr X: 119059748- | | −2.1 |
| 356 | (−) chr X: 124350366- | | 2.1 |
| 357 | (−) chr 1: 20240363-20244851 | | −2.1 |
| 358 | (+) chr 18: 35193025-35193789 | | 2.1 |
| 359 | (−) chr 4: 139253529- | | −2.1 |
| 360 | (−) chr 4: 8535024-8541336 | | 2.1 |
| 361 | (+) chr 1: 143314771- | | 2.1 |
| 362 | (+) chr 12: 42138864-42139645 | | 2.1 |
| 363 | (+) chr 16: 46927838-46928266 | | 2.1 |
| 364 | (−) chr 3: 32480101-32483411 | | 2.1 |
| 365 | (+) chr 7: 6909947-6915150 | | 2.1 |
| 366 | (−) chr 6: 42969387-42979345 | | −2.1 |
| 367 | (−) chr 9: 3800899-3806765 | | −2.1 |
| 368 | (+) chr X: 126317542- | | −2.1 |
| 369 | (−) chr 9: 73768007-73768097 | | −2.1 |
| 370 | (+) chr 8: 98282174-98288062 | | 2.1 |
| 371 | (−) chr 2: 57305890-57306339 | | −2.1 |
| 372 | (+) chr 11: 93718539-93728350 | | 2.1 |
| 373 | (−) chr 5: 95528434-95530534 | | 2.0 |
| 374 | (+) chr 10: 13383338-13383595 | | −2.0 |
| 375 | (−) chr 6: 137423130- | | −2.0 |
| 376 | (−) chr 7: 16683220-16684043 | | 2.0 |
| 377 | (−) chr 8: 138490841- | | −2.0 |
| 378 | (+) chr 9: 12938344-12944129 | | 2.0 |
| 379 | (−) chr 10: 6906147-6915609 | | 2.0 |
| 380 | (−) chr 6: 89180631-89187940 | | 2.0 |
| 381 | (+) chr 2: 193715387- | | 2.0 |
| 382 | (+) chr 10: 55596442-55602269 | | 2.0 |
| 383 | (−) chr Y: 12583289-12583384 | | −2.0 |
| 384 | (−) chr 3: 113765617- | | 2.0 |
| 385 | (+) chr 19: 60146916-60147844 | | −2.0 |
| 386 | (+) chr 10: 135263384- | | 2.0 |
| 387 | (+) chr X: 9597773-9597824 | | 2.0 |
| 388 | (+) chr 3: 143021313- | | 2.0 |
| 389 | (+) chr 19: 60921086-60922051 | | 2.0 |
| 390 | (−) chr 2: 64968050-64971661 | | −2.0 |
| 391 | (+) chr X: 92571323-92580146 | | −2.0 |
| 392 | (+) chr 3: 131413305- | | −2.0 |
| 393 | (+) chr 3: 80520565-80523278 | | −2.0 |
| 394 | (+) chr Y: 4214925-4215289 | | −2.0 |
| 395 | (−) chr 4: 9342496-9343413 | | 2.0 |
| 396 | (+) chr 20: 12681593-12688283 | | 2.0 |
| 397 | (+) chr 19: 42514133-42515114 | | −2.0 |
| 398 | (−) chr 1: 201241191- | | 2.0 |
| 399 | (−) chr 9: 89212806-89213214 | | −2.0 |
| 400 | (+) chr 8: 81814506-81817982 | | 2.0 |
| 401 | (−) chr 1: 186986990- | | 2.0 |
| 402 | (+) chr 2: 187093882- | | 2.0 |
| 403 | (−) chr 12: 13303838-13309720 | x | −2.0 |
| 404 | (−) chr X: 140525604- | | 2.0 |
| 405 | (+) chr 4: 16529457-16529865 | | −2.0 |
| 406 | (−) chr 12: 17066394-17071564 | | 2.0 |
| 407 | (+) chr 3: 133114616- | | −2.0 |
| 408 | (−) chr 1: 69762476-69763180 | | 2.0 |
| 409 | (−) chr 12: 10006301-10012556 | | 2.0 |
| 410 | (+) chr 4: 171274156- | | 1.9 |
| 411 | (−) chr 11: 41479493-41480198 | | −1.9 |
| 412 | (−) chr 7: 140774263- | | −1.9 |
| 413 | (+) chr 19: 48519503-48525376 | | 1.9 |
| 414 | (−) chr 1: 178799179- | | −1.9 |
| 415 | (−) chr 3: 186765708- | | −1.9 |
| 416 | (+) chr 4: 95832427-95833182 | | 1.9 |
| 417 | (−) chr 11: 323775-324167 | | 1.9 |
| 418 | (−) chr 7: 74852868-74853345 | | −1.9 |
| 419 | (+) chr 4: 180878672- | | −1.9 |
| 420 | (−) chr 2: 54587807-54590183 | | −1.9 |
| 421 | (−) chr 10: 94628428-94628493 | | −1.9 |
| 422 | (−) chr 1: 86698092-86698778 | | 1.9 |
| 423 | (−) chr 14: 47817421-47817818 | | −1.9 |
| 424 | (−) chr 12: 105059788- | | −1.9 |
| 425 | (−) chr X: 143109-143553 | | −1.9 |
| 426 | (−) chr 19: 42684487-42685460 | | −1.9 |
| 427 | (+) chr 2: 49358270-49358629 | | 1.9 |
| 428 | (+) chr 20: 24847862-24850357 | | −1.9 |
| 429 | (−) chr 4: 166610633- | x | −1.9 |
| 430 | (+) chr 2: 208689300- | | 1.9 |
| 431 | (−) chr 5: 164658658- | | 1.9 |
| 432 | (−) chr 4: 108869666- | | −1.9 |
| 433 | (+) chr 4: 87614948-87620699 | | 1.9 |
| 434 | (−) chr 1: 220215255- | | 1.9 |
| 435 | (+) chr X: 151048747- | | 1.9 |
| 436 | (+) chr 1: 23573434-23573800 | | −1.9 |
| 437 | (−) chr 4: 126702223- | | −1.9 |
| 438 | (−) chr 15: 53384372-53391861 | | 1.9 |
| 439 | (+) chr 20: 3962724-3963629 | | 1.9 |
| 440 | (−) chr 3: 123372835- | | −1.9 |
| 441 | (−) chr 8: 34837245-34837699 | | 1.9 |
| 442 | (+) chr 16: 69214387-69217522 | | −1.9 |
| 443 | (+) chr 19: 6526246-6528296 | | −1.9 |
| 444 | (−) chr X: 6200259-6202415 | | 1.9 |
| 445 | (+) chr 8: 91057690-91058157 | | 1.9 |
| 446 | (−) chr 13: 103657942- | | −1.9 |

TABLE-continued

| SEQ ID NO: | Chromosomal location | Target tissue | Cancer/normal expression ratio |
|---|---|---|---|
| 447 | (−) chr 3: 167701085- | | 1.9 |
| 448 | (−) chr X: 143109-143553 | | −1.9 |
| 449 | (+) chr 3: 153797495- | | −1.9 |
| 450 | (−) chr 4: 120675771- | | 1.9 |
| 451 | (−) chr 3: 146311752- | | 1.9 |
| 452 | (−) chr 19: 51297295-51305072 | x | 1.9 |
| 453 | (−) chr 7: 120990937- | | 1.8 |
| 454 | (+) chr 19: 40565192-40565689 | | −1.8 |
| 455 | (+) chr 2: 71468737-71476455 | | 1.8 |
| 456 | (−) chr 5: 37310692-37310995 | | −1.8 |
| 457 | (+) chr 6: 99983968-99984924 | | −1.8 |
| 458 | (+) chr 5: 109894536- | | −1.8 |
| 459 | (−) chr 1: 225849586- | | −1.8 |
| 460 | (+) chr 4: 8492255-8492953 | | −1.8 |
| 461 | (+) chr 1: 148873750- | | 1.8 |
| 462 | (−) chr 2: 143169131- | | −1.8 |
| 463 | (−) chr 5: 100347893- | | 1.8 |
| 464 | (−) chr 2: 122158786- | | −1.8 |
| 465 | (+) chr 1: 101404629- | | 1.8 |
| 466 | (+) chr 10: 99039844-99041013 | | 1.8 |
| 467 | (+) chr 2: 215375861- | | 1.8 |
| 468 | (−) chr 1: 96861463-96861850 | | −1.8 |
| 469 | (+) chr 1: 223094264- | | 1.8 |
| 470 | (−) chr 1: 146722974- | | 1.8 |
| 471 | (+) chr X: 133992041- | | −1.8 |
| 472 | (+) chr 2: 201439950- | | −1.8 |
| 473 | (+) chr 19: 19933398-19934392 | | −1.8 |
| 474 | (+) chr X: 70400955-70409404 | | −1.8 |
| 475 | (+) chr 22: 31228741-31234490 | | 1.8 |
| 476 | (+) chr 18: 69142830-69148577 | | 1.8 |
| 477 | (+) chr 7: 143114875- | | 1.8 |
| 478 | (−) chr 2: 143396-148188 | | 1.8 |
| 479 | (−) chr 11: 123241237- | | 1.8 |
| 480 | (+) chr X: 6202415-6205984 | | 1.8 |
| 481 | (+) chr 2: 36679747-36685410 | | 1.8 |
| 482 | (+) chr 8: 115653707- | | −1.8 |
| 483 | (+) chr 20: 40489715-40490155 | | 1.8 |
| 484 | (−) chr 2: 34779941-34781406 | | −1.8 |
| 485 | (−) chr 6: 121983265- | x | 1.8 |
| 486 | (+) chr 9: 34993290-34999332 | | −1.8 |
| 487 | (−) chr Y: 6789347-6789570 | | −1.8 |
| 488 | (+) chr 12: 123156198- | | 1.8 |
| 489 | (−) chr 3: 184711418- | | −1.8 |
| 490 | (+) chr X: 110673691- | | 1.8 |
| 491 | (−) chr 6: 11215545-11220435 | | −1.8 |
| 492 | (−) chr 6: 143442631- | | −1.8 |
| 493 | (+) chr 12: 14111452-14112113 | | −1.8 |
| 494 | (−) chr Y: 10494782-10501363 | | 1.8 |
| 495 | (+) chr 4: 149285541- | | −1.8 |
| 496 | (−) chr 13: 81344919-81345826 | | −1.8 |
| 497 | (+) chr 5: 27512125-27512222 | | 1.8 |
| 498 | (+) chr 4: 184621848- | | −1.8 |
| 499 | (−) chr Y: 14976683-14981289 | | 1.8 |
| 500 | (−) chr 19: 20128147-20129118 | | −1.8 |
| 501 | (−) chr 4: 190637685- | | 1.8 |
| 502 | (−) chr 3: 170033623- | | 1.8 |
| 503 | (−) chr 2: 208795005- | | −1.8 |
| 504 | (+) chr X: 126189732- | | −1.8 |
| 505 | (+) chr 4: 105081874- | | 1.8 |
| 506 | (−) chr 12: 123877603- | | −1.8 |
| 507 | (+) chr 19: 17565375-17569904 | | 1.8 |
| 508 | (+) chr 5: 75726515-75727209 | | −1.8 |
| 509 | (+) chr 16: 35047427-35048394 | | 1.8 |
| 510 | (+) chr 6: 115135872- | | −1.8 |
| 511 | (−) chr 21: 26522067-26527677 | | 1.7 |
| 512 | (+) chr 6: 63353796-63359590 | | −1.7 |
| 513 | (−) chr 5: 124330276- | x | 1.7 |
| 514 | (+) chr 8: 105549953- | | −1.7 |
| 515 | (−) chr 13: 90298826-90304533 | | 1.7 |
| 516 | (−) chr 6: 143652937- | | −1.7 |
| 517 | (+) chr 3: 127091992- | | 1.7 |
| 518 | (−) chr 1: 204451670- | | −1.7 |
| 519 | (−) chr 9: 100067414- | | −1.7 |
| 520 | (+) chr 19: 57753757-57754726 | | 1.7 |
| 521 | (+) chr 14: 73239795-73245370 | | 1.7 |
| 522 | (−) chr 6: 27901601-27902447 | | 1.7 |
| 523 | (+) chr 6: 12779121-12781234 | | −1.7 |
| 524 | (+) chr 11: 117186039- | | −1.7 |
| 525 | (−) chr 2: 3087260-3088202 | | 1.7 |
| 526 | (+) chr 7: 72087433-72087910 | | −1.7 |
| 527 | (+) chr 11: 21981459-21982163 | | −1.7 |
| 528 | (−) chr 19: 41442545-41447962 | | 1.7 |
| 529 | (−) chr 2: 79243805-79250988 | | 1.7 |
| 530 | (+) chr 4: 132806598- | | −1.7 |
| 531 | (+) chr 9: 84688468-84694226 | | 1.7 |
| 532 | (−) chr 10: 17467391-17467759 | | −1.7 |
| 533 | (+) chr 1: 225091861- | | 1.7 |
| 534 | (−) chr 1: 71574420-71575497 | | −1.7 |
| 535 | (−) chr 3: 144273854- | | 1.7 |
| 536 | (+) chr 19: 49834194-49835177 | | 1.7 |
| 537 | (+) chr 2: 78838837-78844899 | | 1.7 |
| 538 | (+) chr 7: 24405964-24408131 | | 1.7 |
| 539 | (+) chr 1: 214248108- | | −1.7 |
| 540 | (−) chr 5: 120061138- | | −1.7 |
| 541 | (+) chr 1: 225351767- | | 1.7 |
| 542 | (−) chr 5: 87508344-87508910 | | 1.7 |
| 543 | (−) chr 4: 65277834-65278217 | | −1.7 |
| 544 | (+) chr 19: 9553879-9554314 | | 1.7 |
| 545 | (+) chr Y: 26648032-26648192 | | −1.7 |
| 546 | (−) chr 3: 111176156- | | −1.7 |
| 547 | (+) chr 10: 57781486-57782256 | | 1.7 |
| 548 | (−) chr 6: 87364687-87370338 | | 1.7 |
| 549 | (+) chr 3: 90214824-90218570 | | −1.7 |
| 550 | (−) chr 4: 62312529-62318338 | | 1.7 |
| 551 | (−) chr 1: 23196587-23203483 | | −1.7 |
| 552 | (−) chr 17: 72296838-72297401 | | −1.7 |
| 553 | (−) chr 1: 171684177- | | 1.7 |
| 554 | (+) chr 12: 30100281-30106718 | | −1.6 |
| 555 | (−) chr 11: 92482373-92482685 | | −1.6 |
| 556 | (+) chr 1: 30046861-30046915 | x | 1.6 |
| 557 | (−) chr X: 114953249- | | 1.6 |
| 558 | (−) chr 6: 120825482- | | 1.6 |
| 559 | (−) chr 4: 180711319- | | 1.6 |
| 560 | (−) chr 2: 58194071-58199769 | | 1.6 |
| 561 | (−) chr 6: 123945178- | | −1.6 |
| 562 | (+) chr 7: 37576063-37576750 | | 1.6 |
| 563 | (+) chr 11: 40847438-40848141 | | −1.6 |
| 564 | (−) chr 10: 59523861-59524645 | | −1.6 |
| 565 | (−) chr 18: 1990815-1991782 | | 1.6 |
| 566 | (−) chr 8: 98855223-98855989 | | 1.6 |
| 567 | (−) chr 8: 56851123-56851350 | | 1.6 |
| 568 | (−) chr 1: 110071319- | | −1.6 |
| 569 | (−) chr 1: 176376976- | | 1.6 |
| 570 | (−) chr 3: 103933971- | | −1.6 |
| 571 | (+) chr 9: 25278245-25284101 | | 1.6 |
| 572 | (+) chr 3: 198155348- | | 1.6 |
| 573 | (−) chr 18: 46184575-46185539 | | −1.6 |
| 574 | (+) chr X: 108039511- | x | −1.6 |
| 575 | (−) chr 18: 38386402-38302105 | | 1.6 |
| 576 | (−) chr 11: 25464616-25468627 | | 1.6 |
| 577 | (+) chr 6: 66335631-66336029 | | 1.6 |
| 578 | (−) chr X: 65011630-65012313 | | −1.6 |
| 579 | (+) chr 5: 54416958-54417356 | | −1.6 |
| 580 | (+) Chr 10: 92557026-92562997 | | −1.6 |
| 581 | (+) chr 6: 121287670- | | −1.6 |
| 582 | (+) chr 14: 70660677-70666478 | | 1.6 |
| 583 | (−) chr 5: 121980485- | | −1.6 |
| 584 | (−) chr 3: 42935348-42935506 | | −1.6 |
| 585 | (−) chr X: 72938020-72941188 | | 1.6 |
| 586 | (+) chr 5: 97441794-97446777 | | −1.6 |
| 587 | (−) chr 6: 5981329-5981780 | | 1.6 |
| 588 | (−) chr 18: 24532993-24533490 | | −1.6 |
| 589 | (+) chr 12: 57531903-57539801 | | 1.6 |
| 590 | (+) chr 3: 146910972- | | 1.6 |
| 591 | (+) chr 1: 220205889- | | 1.6 |
| 592 | (+) chr 3: 133508751- | | −1.6 |
| 593 | (−) chr 7: 65721380-65722348 | | 1.6 |
| 594 | (−) chr 6: 138729599- | | −1.6 |
| 595 | (+) chr 5: 5852293-5852397 | | 1.6 |
| 596 | (+) chr 5: 123667350- | | −1.6 |
| 597 | (+) chr 10: 45388242-45391541 | | −1.6 |
| 598 | (+) chr 2: 201435182- | | 1.5 |

TABLE-continued

| SEQ ID NO: | Chromosomal location | Target tissue | Cancer/normal expression ratio |
|---|---|---|---|
| 599 | (−) chr 19: 23698300-23699266 | | 1.5 |
| 600 | (−) chr 6: 16367220-16373103 | | 1.5 |
| 601 | (+) chr X: 32466196-32466630 | | 1.5 |
| 602 | (+) chr 8: 56782206-56782449 | | 1.5 |
| 603 | (−) chr 2: 32354155-32355122 | | −1.5 |
| 604 | (+) chr 3: 187581597- | | 1.5 |
| 605 | (−) chr 4: 178566070- | | 1.5 |
| 606 | (−) chr 8: 99671725-99672015 | | 1.5 |
| 607 | (−) chr 20: 33313343-33314310 | | −1.5 |
| 608 | (+) chr 8: 74996654-74897392 | | −1.5 |
| 609 | (+) chr 6: 131841491- | | −1.5 |
| 610 | (+) chr 22: 31285355-31286293 | | −1.5 |
| 611 | (+) chr 7: 134507781- | | −1.5 |
| 612 | (+) chr 15: 33670273-33670510 | | 1.5 |
| 613 | (−) chr 16: 8834700-8846815 | | 1.5 |
| 614 | (−) chr 6: 111682993- | | −1.5 |
| 615 | (−) chr 6: 10692164-10693125 | | 1.5 |
| 616 | (+) chr 2: 231973667- | | −1.5 |
| 617 | (+) chr 7: 98867298-98868316 | | 1.5 |
| 618 | (+) chr 1: 227156668- | | −1.5 |
| 619 | (+) chr 11: 18554017-18554073 | | −1.5 |
| 620 | (+) chr 17: 57579448-57580087 | | 1.5 |
| 621 | (+) chr 13: 34271392-34275485 | | 1.5 |
| 622 | (−) chr 4: 190639686- | | −1.5 |
| 623 | (−) chr 19: 58630272-58630359 | | 1.5 |
| 624 | (+) chr 5: 146366545- | | −1.5 |
| 625 | (−) chr 18: 69786076-69786793 | | −1.5 |
| 626 | (−) chr 1: 231675180- | | 1.5 |
| 627 | (−) chr 21: 41718929-41719369 | | 1.5 |
| 628 | (+) chr 6: 131867158- | | 1.5 |
| 629 | (−) chr 6: 19322317-19322689 | | −1.5 |
| 630 | (+) chr 15: 99430215-99436023 | | −1.5 |
| 631 | (+) chr 1: 113153812- | | 1.5 |
| 632 | (−) chr 7: 39726352-39726804 | | −1.5 |
| 633 | (+) chr 11: 302654-302777 | | 1.5 |
| 634 | (+) chr 17: 47552407-47552568 | | 1.5 |
| 635 | (+) chr 3: 116946112- | | −1.5 |
| 636 | (−) chr 9: 116976750- | | 1.5 |
| 637 | (−) chr 5: 43112885-43113865 | | −1.5 |
| 638 | (+) chr 17: 70760297-70765658 | | 1.5 |
| 639 | (+) chr 3: 180717551- | | −1.5 |
| 640 | (−) chr 8: 115366935- | | 1.5 |
| 641 | (+) chr 7: 63722090-63722123 | | −1.5 |
| 642 | (+) chr 4: 166213734- | | −1.5 |
| 643 | (−) chr 19: 43813619-43814569 | | 1.5 |
| 644 | (+) chr 4: 6560755-6561735 | | −1.5 |
| 645 | (−) chr 11: 69581214-69582655 | | 1.5 |
| 646 | (+) chr 14: 25196411-25196706 | | −1.5 |
| 647 | (+) chr 3: 10747162-10747573 | | −1.5 |
| 648 | (+) chr 1: 69101725-69102525 | | −1.5 |
| 649 | (−) chr 10: 62463482-62469677 | | 1.5 |
| 650 | (+) chr X: 113117901- | | 1.5 |
| 651 | (−) chr 15: 49734758-49735530 | | 1.5 |
| 652 | (+) chr 4: 68579259-68585888 | | 1.5 |
| 653 | (+) chr 8: 7247222-7250906 | | −1.5 |
| 654 | (−) chr 9: 87683968-87685669 | | 1.5 |
| 655 | (−) chr Y: 21474197-21476283 | | −1.5 |
| 656 | (−) chr 6: 138081758- | | −1.4 |
| 657 | (−) chr 4: 180565288- | | −1.4 |
| 658 | (+) chr 1: 46558555-46559522 | | 1.4 |
| 659 | (−) chr 21: 20291919-20292024 | | 1.4 |
| 660 | (−) chr 3: 190583155- | | −1.4 |
| 661 | (+) chr 12: 122598918- | | 1.4 |
| 662 | (+) chr 16: 30051793-30051970 | | −1.4 |
| 663 | (+) chr 1: 205873717- | | 1.4 |
| 664 | (−) chr 11: 23865384-23871043 | | 1.4 |
| 665 | (−) chr 17: 75988189-75996283 | | −1.4 |
| 666 | (+) chr 8: 120998753- | | 1.4 |
| 667 | (+) chr 16: 29617077-29617563 | | 1.4 |
| 668 | (+) chr 20: 32476466-32477455 | | 1.4 |
| 669 | (+) chr 4: 1992875-1993855 | | 1.4 |
| 670 | (+) chr 11: 18656991-18657966 | | 1.4 |
| 671 | (−) chr 6: 125796517- | | −1.4 |
| 672 | (+) Chr 7: 65695119-65695525 | | 1.4 |
| 673 | (−) chr 1: 36727172-36729315 | | −1.4 |
| 674 | (−) chr 10: 32280890-32281905 | | −1.4 |
| 675 | (−) chr 1: 181128423- | | −1.4 |
| 676 | (+) chr 2: 150677477- | | −1.4 |
| 677 | (+) chr 4: 69147257-69150858 | | −1.4 |
| 678 | (+) chr 2: 127843921- | | −1.4 |
| 679 | (+) chr 14: 48285270-48286069 | | −1.4 |
| 680 | (−) chr 5: 170366881- | | −1.4 |
| 681 | (+) chr 2: 190853307- | | 1.4 |
| 682 | (+) chr 3: 133850331- | | −1.4 |
| 683 | (+) chr 1: 244312610- | | 1.4 |
| 684 | (+) chr 13: 40927858-40928571 | | 1.4 |
| 685 | (−) chr 20: 740491-741481 | | 1.4 |
| 686 | (+) chr 12: 34314239-34318461 | | 1.4 |
| 687 | (−) chr 8: 37977344-37980797 | | −1.4 |
| 688 | (−) chr 13: 53599552-53605294 | | −1.4 |
| 689 | (−) chr 12: 20862483-20866818 | | 1.4 |
| 690 | (−) chr 4: 107551081- | | −1.4 |
| 691 | (+) chr 3: 172777168- | | 1.4 |
| 692 | (+) chr 2: 34773168-34775448 | | −1.4 |
| 693 | (−) chr 7: 147637439- | | 1.4 |
| 694 | (+) chr 4: 175540733- | | −1.4 |
| 695 | (+) chr 12: 60267154-60272981 | | −1.4 |
| 696 | (−) chr 6: 111714710- | | 1.4 |
| 697 | (−) chr 15: 39364817-39365176 | | −1.4 |
| 698 | (−) chr 19: 46119961-46120936 | | −1.4 |
| 699 | (+) chr X: 138586657- | | −1.4 |
| 700 | (+) chr 14: 99217652-99218668 | | −1.3 |
| 701 | (−) chr 7: 54710388-54711318 | | 1.3 |
| 702 | (+) chr 2: 20145804-20151367 | | 1.3 |
| 703 | (+) chr 5: 23010457-23010195 | | −1.3 |
| 704 | (−) chr 12: 57223212-57224172 | | −1.3 |
| 705 | (+) chr 2: 57102769-57103266 | | −1.3 |
| 706 | (−) chr 21: 16686151-16692725 | | −1.3 |
| 707 | (+) chr X: 138823266- | | 1.3 |
| 708 | (+) chr 1: 71391936-71392646 | | −1.3 |
| 709 | (−) chr 3: 46404182-46406028 | | −1.3 |
| 710 | (−) chr 19: 57894687-57394794 | | 1.3 |
| 711 | (+) chr 1: 148879269- | | 1.3 |
| 712 | (+) chr 2: 18474209-18474872 | | −1.3 |
| 713 | (−) chr 18: 31190100-31195753 | | 1.3 |
| 714 | (+) chr 4: 108431187- | | 1.3 |
| 715 | (+) chr 6: 142192789- | | −1.3 |
| 716 | (−) chr 7: 68382377-68383085 | | −1.3 |
| 717 | (−) chr 7: 146321019- | | −1.3 |
| 718 | (+) chr 10: 17459042-17459400 | | 1.3 |
| 719 | (+) chr 20: 58157372-58158054 | | −1.3 |
| 720 | (−) chr 11: 67365951-67369209 | | 1.3 |
| 721 | (−) chr 15: 85331036-85331493 | | 1.3 |
| 722 | (+) chr 14: 95509121-95514952 | | 1.3 |
| 723 | (+) chr 17: 11815798-11820989 | | 1.3 |
| 724 | (+) chr 11: 102287978- | | 1.3 |
| 725 | (+) chr 2: 12683912-12689836 | | 1.3 |
| 726 | (−) chr 9: 15409320-15410036 | | 1.3 |
| 727 | (−) chr 18: 22761239-22762201 | | −1.3 |
| 728 | (+) chr 18: 62088302-62089092 | | −1.3 |
| 729 | (−) chr 2: 101234165- | | 1.3 |
| 730 | (−) chr 17: 16678919-16679896 | | −1.3 |
| 731 | (+) chr 4: 27585609-27586295 | | −1.3 |
| 732 | (−) chr 5: 129908476- | | 1.3 |
| 733 | (−) chr 7: 52362517-52362663 | | 1.3 |
| 734 | (+) chr 4: 177503741- | | 1.3 |
| 735 | (+) chr 4: 155197148- | | −1.3 |
| 736 | (−) chr 20: 23789232-23790195 | | 1.3 |
| 737 | (−) chr 10: 52210114-52210776 | | −1.3 |
| 738 | (+) chr 1: 223480928- | | −1.3 |
| 739 | (+) chr 1: 181631981- | | 1.3 |
| 740 | (+) chr 6: 57801841-57802593 | | 1.3 |
| 741 | (−) chr 16: 18909966-18916124 | | −1.3 |
| 742 | (−) chr 19: 57024203-57024671 | | 1.3 |
| 743 | (+) chr 3: 177261846- | | 1.3 |
| 744 | (+) chr 6: 142378496- | | −1.2 |
| 745 | (+) chr 6: 160569673- | | −1.2 |
| 746 | (+) chr 6: 153045773- | | −1.2 |
| 747 | (+) chr 4: 8486531-8489137 | | −1.2 |
| 748 | (−) chr 2: 52103626-52108242 | | −1.2 |
| 749 | (+) chr 5: 23446789-23447501 | | 1.2 |
| 750 | (−) chr 7: 27747804-27748772 | | 1.2 |

TABLE-continued

| SEQ ID NO: | Chromosomal location | Target tissue | Cancer/normal expression ratio |
|---|---|---|---|
| 751 | (+) chr 13: 55144122-55144740 | | −1.2 |
| 752 | (+) chr 6: 119115236- | | 1.2 |
| 753 | (+) chr 11: 76938868-76944155 | | 1.2 |
| 754 | (−) chr 7: 53274415-53274795 | | 1.2 |
| 755 | (+) chr 7: 32838698-32844410 | | 1.2 |
| 756 | (+) chr 6: 154285557- | | 1.2 |
| 757 | (+) chr 1: 53393934-53394604 | | 1.2 |
| 758 | (−) chr 4: 47707230-47708025 | | −1.2 |
| 759 | (+) chr 11: 77430014-77430764 | | 1.2 |
| 760 | (+) chr 4: 109853300- | | −1.2 |
| 761 | (−) chr 2: 193114913- | | −1.2 |
| 762 | (−) chr 5: 42324347-42324788 | | −1.2 |
| 763 | (+) chr 3: 113681517- | | 1.2 |
| 764 | (−) chr 7: 26030345-26035880 | | 1.2 |
| 765 | (+) chr 3: 45956645-45957363 | | 1.2 |
| 766 | (−) chr 4: 135818540- | | −1.2 |
| 767 | (−) chr 14: 100841342- | | −1.2 |
| 768 | (−) chr 2: 69523645-69529977 | | −1.2 |
| 769 | (−) chr 13: 69087011-69087975 | | −1.2 |
| 770 | (−) chr 6: 21469700-21475467 | | −1.2 |
| 771 | (−) chr 2: 101341556- | | 1.2 |
| 772 | (−) chr 3: 61653185-61653588 | | −1.2 |
| 773 | (−) chr 13: 88856202-88856780 | | 1.1 |
| 774 | (−) chr 2: 40978866-40978933 | | 1.1 |
| 775 | (−) chr 20: 54220244-54221269 | | −1.1 |

The subject of the present invention is therefore a method for the in vitro diagnosis of testicular cancer or for the in vitro prognosis of the seriousness of testicular cancer in a biological sample taken from a patient, which comprises detecting at least one expression product of at least one nucleic acid sequence, said nucleic acid sequence being chosen from the full-length sequences identified in SEQ ID NOs: 1 to 775 or from the sequences which exhibit at least 99% identity, preferably at least 99.5% identity and advantageously at least 99.6% or at least 99.7% identity with one of the full-length sequences identified in SEQ ID NOs: 1 to 775.

The diagnosis makes it possible to establish whether or not an individual is ill. The prognosis makes it possible to establish a degree of seriousness of the disease (grades and/or stages) which has an effect on the survival and/or quality of life of the individual. In the context of the present invention, the diagnosis may be very early, possibly up to several months before the revealing of the tumor in cases of seminoma.

The percentage identity described above has been determined by taking into consideration the nucleotide diversity in the genome. It is known that nucleotide diversity is higher in regions of the genome that are rich in repeat sequences than in regions which do not contain repeat sequences. By way of example, Nickerson D. A. et al. (1) have shown a diversity of approximately 0.3% (0.32%) in regions containing repeat sequences.

The ability to discriminate a cancerous state of each of the sequences identified above has been demonstrated by means of a statistical analysis using the SAM procedure (5), followed by correction by means of the rate of false positives (6) and by elimination of the values below $2^6$. Consequently, each of the sequences identified above exhibits a significant difference in expression between a tumor state and a normal state. As a result of this, a difference in expression observed for one of the abovementioned sequences constitutes a signature of the pathological condition. Of course, it is possible to combine the differences in expression noted for several of the sequences referenced above for example by one or more combinations of 2, 3, 4, 5, 6, 7, 8, 9, 10 and more up to 775 of the listed sequences. In particular, the sequences identified in SEQ ID NOs: 1, 26 and 29, taken alone or in combination (in pairs or all three) constitute one or more preferred signatures.

Thus, in the method of the invention, at least two expression products respectively of at least two nucleic acid sequences are detected, said nucleic acid sequences being chosen from the sequences identified in SEQ ID NOs: 1 to 775 or from the sequences which exhibit at least 99% identity, preferably at least 99.5% identity and advantageously at least 99.6% or at least 99.7% identity with one of the sequences identified in SEQ ID NOs: 1 to 775.

In one embodiment of the method according to the invention, the expression product of at least two nucleic acid sequences is detected, said at least two nucleic acid sequences being chosen from the sequences identified as being specific for testicular tissue, i.e. chosen from the group of sequences identified in SEQ ID NOs: 1, 2, 3, 4, 5, 7, 8, 9, 10, 11, 12, 13, 14, 15, 16, 17, 18, 19, 20, 21, 23, 24, 25, 26, 27, 29, 31, 32, 33, 34, 36, 38, 39, 40, 41, 42, 43, 44, 45, 46, 47, 50, 51, 52, 53, 57, 58, 59, 61, 63, 64, 65, 68, 70, 71, 72, 74, 75, 76, 77, 78, 79, 80, 83, 84, 85, 86, 87, 88, 89, 90, 91, 92, 94, 96, 97, 102, 104, 106, 107, 109, 110, 115, 116, 118, 121, 122, 123, 127, 132, 133, 136, 137, 142, 147, 148, 150, 159, 160, 162, 163, 164, 165, 166, 167, 170, 171, 175, 182, 187, 191, 198, 199, 201, 207, 210, 216, 219, 222, 224, 228, 230, 234, 244, 256, 263, 265, 266, 269, 271, 281, 286, 288, 291, 292, 296, 298, 304, 308, 333, 341, 347, 403, 429, 452, 485, 513, 556, 574 and 755 or from the sequences which exhibit at least 99% identity, preferably at least 99.5% identity and advantageously at least 99.6% or at least 99.7% identity with one of the sequences identified in SEQ ID NOs: 1, 2, 3, 4, 5, 7, 8, 9, 10, 11, 12, 13, 14, 15, 16, 17, 18, 19, 20, 21, 23, 24, 25, 26, 27, 29, 31, 32, 33, 34, 36, 38, 39, 40, 41, 42, 43, 44, 45, 46, 47, 50, 51, 52, 53, 57, 58, 59, 61, 63, 64, 65, 68, 70, 71, 72, 74, 75, 76, 77, 78, 79, 80, 83, 84, 85, 86, 87, 88, 89, 90, 91, 92, 94, 96, 97, 102, 104, 106, 107, 109, 110, 115, 116, 118, 121, 122, 123, 127, 132, 133, 136, 137, 142, 147, 148, 150, 159, 160, 162, 163, 164, 165, 166, 167, 170, 175, 182, 187, 191, 198, 199, 201, 207, 210, 216, 219, 222, 224, 228, 230, 234, 244, 256, 263, 265, 266, 269, 271, 281, 286, 288, 291, 232, 296, 298, 304, 308, 333, 341, 347, 403, 429, 452, 485, 513, 556, 574 and 755.

In another embodiment of the method of the invention, the expression product of at least one sequence chosen from the sequences identified as being specific for testicular tissue, i.e. chosen from the group of sequences identified in SEQ ID NOs: 1, 2, 3, 4, 5, 7, 8, 9, 10, 11, 12, 13, 14, 15, 16, 17, 18, 19, 20, 21, 23, 24, 25, 26, 27, 29, 31, 32, 33, 34, 36, 38, 39, 40, 41, 42, 43, 44, 45, 46, 47, 50, 51, 52, 53, 57, 58, 59, 61, 63, 64, 65, 68, 70, 71, 72, 74, 75, 76, 77, 78, 79, 80, 83, 84, 85, 86, 87, 88, 89, 90, 91, 92, 94, 96, 97, 102, 104, 106, 107, 109, 110, 115, 116, 118, 121, 122, 123, 127, 132, 133, 136, 137, 142, 147, 148, 150, 159, 160, 162, 163, 164, 165, 166, 167, 170, 171, 175, 182, 187, 191, 198, 199, 201, 207, 210, 216, 219, 222, 224, 228, 230, 234, 244, 256, 263, 265, 266, 269, 271, 281, 286, 288, 291, 292, 296, 298, 304, 308, 333, 341, 347, 403, 429, 452, 485, 513, 556, 574 and 755 or chosen from the sequences which exhibit at least 99% identity, preferably at least 99.5% identity and advantageously at least 99.6% or at least 99.7% identity with one of the sequences identified in SEQ ID NOs: 1, 2, 3, 4, 5, 7, 8, 9, 10, 11, 12, 13, 14, 15, 16, 17, 18, 19, 20, 21, 23, 24, 25, 26, 27, 29, 31, 32, 33, 34, 36, 38, 39, 40, 41, 42, 43, 44, 45, 46, 47, 50, 51, 52, 53, 57, 58, 59, 61, 63, 64, 65, 68, 70, 71, 72, 74, 75, 76, 77, 78, 79, 80, 83, 84, 85, 86, 87, 88, 89, 90, 91, 92, 94, 96, 97, 102, 104, 106, 107, 109, 110, 115, 116, 118, 121, 122, 123, 127, 132, 133, 136, 137, 142, 147, 148, 150, 159, 160, 162, 163, 164, 165, 166, 167, 170, 171, 175, 182, 187, 191, 198, 199, 201, 207, 210, 216, 219, 222, 224, 228, 230, 234, 244, 256, 263, 265, 266, 269, 271, 281, 286, 288, 291, 292, 296, 298, 304, 308, 333, 341, 347, 403, 429, 452, 485, 513, 556, 574 and 755 and the expression product of at least one sequence chosen from the sequences identified as being not specific for testicular tissue, i.e. chosen from the group of sequences identified in SEQ ID NOs: 6, 22, 28, 30, 35, 37, 46, 49, 54, 55, 56, 60, 62, 66, 67, 69, 73, 81, 82, 93, 95, 98, 99, 100, 101, 103, 105, 108, 111, 112, 113, 114, 117, 119, 120, 124, 125, 126, 128, 129, 130, 131, 134, 135, 138, 139, 140, 141, 143, 144, 145, 146, 149, 151, 152, 153, 154, 155, 156, 157, 158, 161, 163, 169, 172, 173, 174, 176, 177, 178, 179, 180, 181, 183, 184, 185, 186, 188, 189, 190, 192, 193, 194, 195, 196, 197, 200, 202, 203, 204, 205, 206, 208, 209, 211, 212, 213, 214, 215, 217, 218, 220, 221, 223, 225, 226, 227, 229, 231, 232, 233, 235, 236, 237, 238, 239, 240, 241, 242, 243, 245, 246, 247, 248, 249, 250, 251, 252, 253, 254, 255, 257, 258, 259, 260, 261, 262, 264, 267, 268, 270, 272, 273, 274, 275, 276, 277, 278, 279, 280, 282, 283, 284, 285, 287, 289, 290, 293, 294, 295, 297, 299, 300, 301, 302, 303, 305, 306, 307, 309, 310, 311, 312, 313, 314, 315, 316, 317, 318, 319, 320, 321, 322, 323, 324, 325, 326, 327, 328, 329, 330, 331, 332, 334, 335, 336, 337, 338, 339, 340, 342, 343, 344, 345, 346, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 404, 405, 406, 407, 408, 409, 410, 411, 412, 413, 414, 415, 416, 417, 418, 419, 420, 421, 422, 423, 424, 425, 426, 427, 428, 430, 431, 432, 433, 434, 435, 436, 437, 438, 439, 440, 441, 442, 443, 444, 445, 446, 447, 448, 449, 450, 451, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 486, 487, 488, 489, 490, 491, 492, 493, 494, 495, 496, 497, 498, 499, 500, 501, 502, 503, 504, 505, 506, 507, 508, 509, 510, 511, 512, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 557, 558, 559, 560, 561, 562, 563, 564, 565, 566, 567, 568, 569, 570, 571, 572, 573, 575, 576, 577, 578, 579, 580, 581, 582, 583, 534, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 698, 699, 700, 701, 702, 703, 704, 705, 706, 707, 708, 709, 710, 711, 712, 713, 714, 715, 716, 717, 718, 719, 720, 721, 722, 723, 724, 725, 726, 727, 728, 729, 730, 731, 732, 733, 734, 735, 736, 737, 738, 739, 740, 741, 742, 743, 744, 745, 746, 747, 748, 749, 750, 751, 752, 753, 754, 756, 757, 758, 759, 760, 761, 762, 763, 764, 765, 766, 767, 768, 769, 770, 771, 772, 773, 774 and 775.

In particular, in the method of the invention, the expression product of at least one nucleic acid sequence, preferably of at least two nucleic acid sequences or of three nucleic acid sequences is detected, said nucleic acid sequences being chosen from the group of sequences identified in SEQ ID NOs: 1, 26 and 29, or from the sequences which exhibit at least 99% identity, preferably at least 99.5% identity and advantageously at least 99.6% or at least 99.7% identity with the sequences identified in SEQ ID NOs: 1, 26 and 29.

The expression product detected is at least one RNA transcript, in particular at least one mRNA or at least one polypeptide.

When the expression product is an mRNA transcript, it is detected by any appropriate method, such as hybridization, sequencing or amplification. The mRNA may be detected directly by bringing into contact with at least one probe and/or at least one primer which are designed so as to hybridize to the mRNA transcripts under predetermined experimental conditions, demonstrating the presence or the absence of hybridization to the mRNA and optionally quantifying the mRNA. Among the preferred methods, mention may be made of amplification (for example, RT-PCR, NASBA, etc.), hybridization on a chip or else sequencing. The mRNA may also be detected indirectly using nucleic acids derived from said transcripts, such as cDNA copies, etc.

Generally, the method of the invention comprises an initial step of extracting the mRNA from the sample to be analyzed.

Thus, the method may comprise:
(i) a step of extracting the mRNA from the sample to be analyzed,
(ii) a step of detecting and quantifying the mRNA from the sample to be analyzed,
(iii) a step of extracting the mRNA in a reference sample, which may be a healthy sample originating in the same individual, or
(iv) a step of detecting and quantifying the mRNA from the healthy sample,
(v) a step of comparing the amount of mRNA expressed in the sample to be analyzed and in the reference sample; it being possible for the determination of an amount of mRNA expressed in the sample to be analyzed which is different than the amount of mRNA expressed in the healthy reference sample to be correlated with the diagnosis or the prognosis of the seriousness of testicular cancer (the difference in the amount of mRNA in the cancerous testicular tissue relative to the amount of mRNA expressed in the healthy testicular tissue being indifferently an expression, an overexpression or an underexpression);
and in particular:
(i) an extraction of the mRNA to be analyzed from the sample,
(ii) a determination, in the RNA to be analyzed, of an expression level of at least one RNA sequence in the sample, said RNA sequence being the transcription product of at least one nucleic acid sequence chosen from the sequences identified in SEQ ID NOs: 1 to 775 or from the sequences which exhibit at least 99% identity, preferably at least 99.5% identity and advantageously at least 99.6% or at least 99.7% identity with one of the sequences identified in SEQ ID NOs: 1 to 775, and
(iii) a comparison of the expression level of the
RNA sequence(s) defined in (ii) with a reference expression level; it being possible for the determination of an expression level of the RNA to be analyzed which exhibits a difference relative to the reference expression level to be correlated with the diagnosis or the prognosis of testicular cancer (as determined above); or
(i) a step of extracting the mRNA from the sample to be analyzed,
(ii) a step of detecting and quantifying the mRNA from the sample to be analyzed,
(iii) a step of comparing the amount of mRNA expressed in the sample to foe analyzed relative to an amount of reference mRNA, it being possible for the determination of an amount of mRNA expressed in the sample to be analyzed which is different than the amount of reference mRNA to be correlated with the diagnosis or the prognosis of testicular cancer (the difference in the amount of mRNA in the sample to toe analyzed relative to the amount of reference mRNA being indifferently an expression, an overexpression or an underexpression).

In one embodiment of the method of the invention, DNA copies of the mRNA are prepared, the DNA copies are brought into contact with at least one probe and/or at least one primer under predetermined conditions which allow hybridization, and the presence or absence of hybridization to said DNA copies is detected.

The expression product which is detected may also be a polypeptide which is the translation product of at least one of the transcripts described above. In this case, the polypeptide expressed is detected by bringing into contact with at least one specific binding partner of said polypeptide, in particular an antibody or an antibody analog or an aptamer. The binding partner is preferably an antibody, for example a monoclonal antibody or a polyclonal antibody which is highly purified or an antibody analog, for example an affinity protein with competitive properties (nanofitin™).

The polyclonal antibodies can be obtained by immunization of an animal with the appropriate immunogen, followed by recovery of the desired antibodies in purified form, by taking the serum of said animal, and separation of said antibodies from the other serum constituents, in particular by affinity chromatography on a column to which an antigen specifically recognized by the antibodies is bound.

The monoclonal antibodies can be obtained by means of the hybridoma technology, the general principle of which is summarized below.

Firstly, an animal, generally a mouse, is immunized with the appropriate immunogen, and the B lymphocytes of said mouse are then capable of producing antibodies against this antigen. These antibody-producing lymphocytes are then fused with "immortal" myeloma cells (murine in the example) so as to give rise to hybridomas. The cells capable of producing a particular antibody and of multiplying indefinitely are then selected from the heterogeneous mixture of cells thus obtained. Each hybridoma is multiplied in the form of a clone, each one resulting in the production of a monoclonal antibody in which the properties of recognition with respect to the protein may be tested, for example, by ELISA, by one-dimensional or two-dimensional Western blotting, by immunofluorescence, or using a biosensor. The monoclonal antibodies thus selected are subsequently purified, in particular according to the affinity chromatography technique described above.

The monoclonal antibodies may also be recombinant antibodies obtained by genetic engineering, using techniques well known to those skilled in the art.

Nanofitins™ are small proteins which, like antibodies, are capable of binding to a biological target, thus making it possible to detect it, to capture it or quite simply to target it within an organism. They are presented, inter alia, as antibody analogs.

Aptamers are synthetic oligonucleotides capable of binding a specific ligand.

The invention also relates to the use of at least one nucleic acid sequence, which has been isolated, as a molecular marker for the in vitro diagnosis or prognosis of testicular cancer, characterized in that said nucleic acid sequence consists of:
(i) at least one DNA sequence chosen from the sequences SEQ ID NOs: 1 to 775, or
(ii) at least one DNA sequence complementary to a sequence chosen from the sequences SEQ ID NOs: 1 to 775, or
(iii) at least one DNA sequence which exhibits at least 99% identity, preferably at least 99.5% identity and advantageously at least 99.6% or at least 99.7% identity with a sequence as defined in (i) and (ii), or (iv) at least one RNA sequence which is the transcription product of a sequence chosen from the sequences as defined in (i), or
(v) at least one RNA sequence which is the transcription product of a sequence chosen from the sequences which exhibit at least 99% identity, preferably at least 99.5% identity and advantageously at least 99.6% or at least 99.7% identity with a sequence as defined in (i).

In one embodiment, use is made of at least two nucleic acid sequences which consist of:
(i) at least two DNA sequences chosen from the sequences SEQ ID NOs: 1 to 775, preferably chosen from the sequences identified in SEQ ID NOs: 1, 2, 3, 4, 5, 7, 8, 9, 10, 11, 12, 13, 14, 15, 16, 17, 18, 19, 20, 21, 23, 24, 25, 26, 27, 29, 31, 32, 33, 34, 36, 38, 39, 40, 41, 42, 43, 44, 45, 46, 47, 50, 51, 52, 53, 57, 58, 59, 61, 63, 64, 65, 68, 70, 71, 72, 74, 75, 76, 77, 78, 79, 80, 83, 84, 85, 86, 87, 88, 89, 90, 91, 92, 94, 96, 97, 102, 104, 106, 107, 109, 110, 115, 116, 118, 121, 122, 123, 127, 132, 133, 136, 137, 142, 147, 148, 150, 159, 160, 162, 163, 164, 165, 166, 167, 170, 171, 175, 182, 187, 191, 198, 199, 201, 207, 210, 216, 219, 222, 224, 228, 230, 234, 244, 256, 263, 265, 266, 269, 271, 281, 286, 288, 291, 292, 296, 298, 304, 308, 333, 341, 347, 403, 429, 432, 435, 513, 556, 574 and 755 and in particular the sequences SEQ ID Nos: 1, 26 and 29, or
(ii) at least two DNA sequences respectively complementary to at least two sequences chosen from the sequences SEQ ID Nos: 1 to 775, preferably chosen from the sequences identified in SEQ ID NOs: 1, 2, 3, 4, 5, 7, 8, 9, 10, 11, 12, 13, 14, 15, 16, 17, 18, 19, 20, 21, 23, 24, 25, 26, 27, 29, 31, 32, 33, 34, 36, 38, 39, 40, 41, 42, 43, 44, 45, 46, 47, 50, 51, 52, 53, 57, 58, 59, 61, 63, 64, 65, 68, 70, 71, 72, 74, 75, 76, 77, 78, 79, 80, 83, 84, 85, 86, 87, 88, 89, 90, 91, 92, 94, 96, 97, 102, 104, 106, 107, 109, 110, 115, 116, 118, 121, 122, 123, 127, 132, 133, 136, 137, 142, 147, 148, 150, 159, 160, 162, 163, 164, 165, 166, 167, 170, 171, 175, 182, 187, 191, 198, 199, 201, 207, 210, 216, 219, 222, 224, 228, 230, 234, 244, 255, 263, 265, 266, 269, 271, 281, 286, 288, 291, 292, 296, 298, 304, 308, 333, 341, 347, 403, 429, 452, 485, 513, 356, 574 and 755 and in particular from the sequences SEQ ID Nos: 1, 26 and 29, or
(iii) an least two DNA sequences which exhibit respectively at least 99% identity, preferably at least 99.5% identity and advantageously at least 99.6% or at least 99.7% identity with two sequences as defined in (i) and (ii), or
(iv) at least two DNA sequences which are respectively the transcription product of two sequences chosen from the sequences as defined in (i), or
(v) at least two DNA sequences which are the transcription product of two sequences chosen from the sequences which exhibit at least 99% identity, preferably at least 99.5% identity and advantageously at least 99.6% or at least 99.7% identity with the sequences as defined in (i).

A subject of the invention is also a kit for the in vitro diagnosis or prognosis of testicular cancer in a biological sample taken from a patient, which comprises at least one specific binding partner of at least one expression product of at least one nucleic acid sequence chosen from the sequences identified in SEQ ID NOs: 1 to 775 or from the sequences which exhibit at least 99% identity, preferably at least 99.5% identity, advantageously at least 99.6% or at least 99.7% identity with the nucleic acid sequences identified in SEQ ID KOs: 1 to 775 and no more than 775 specific binding partners of the expression products of the nucleic acid sequences identified in SEQ ID NOs: 1 to 775 or of the nucleic acid sequences which exhibit at least 99% identity with the nucleic acid sequences identified in SEQ ID NOs: 1 to 775, preferably at least 99.5% identity and advantageously at least 99.6% or at least 99.7% identity with one of the sequences identified in SEQ ID NOs: 1 to 775.

Preferably, the kit comprises a specific binding partner of the expression product of at least one nucleic acid sequence chosen from the group of sequences identified in SEQ ID NOs; 1, 26 and 29 or of the sequences which exhibit at least 99% identity, preferably at least 99.5% identity and advantageously at least 99.6% or at least 99.7% identity with the sequences identified in SEQ ID NOs: 1, 26 and 29.

In one embodiment, the kit comprises at least two respectively specific binding partners of at least two expression products of at least two nucleic acid sequences chosen from the sequences identified in SEQ ID NOs: 1 to 775 or from the sequences which exhibit at least 99% identity, preferably at feast 99.5% identity and advantageously at least 99.6% or at least 99.7% identity with the nucleic acid sequences identified in SEQ ID NOs: 1 to 775 and no more than 775 specific binding partners of the expression products of the nucleic acid sequences identified in SEQ ID NOs: 1 to 775 or of the nucleic acid sequences which exhibit at least 99% identity, preferably at least 99.5% identity and advantageously at least 99.6% or at least 99.7% identity with the nucleic acid sequences identified in SEQ ID NOs: 1 to 775.

For example, the kit comprises at least two respectively specific binding partners of the expression product of at least two nucleic acid sequences chosen from the group of sequences identified in SEQ ID NOs: 1, 2, 3, 4, 5, 7, 8, 9, 10, 11, 12, 13, 14, 15, 16, 17, 18, 19, 20, 21, 23, 24, 25, 26, 27, 29, 31, 32, 33, 34, 36, 38, 39, 40, 41, 42, 43, 44, 45, 46, 47, 50, 51, 52, 53, 57, 58, 59, 61, 63, 64, 65, 68, 70, 71, 72, 74, 75, 76, 77, 78, 79, 80, 83, 84, 85, 86, 87, 88, 89, 90, 91, 92, 94, 96, 97, 102, 104, 106, 107, 109, 110, 115, 116, 118, 121, 122, 123, 127, 132, 133, 136, 137, 142, 147, 148, 150, 159, 160, 162, 163, 164, 165, 166, 167, 170, 171, 175, 182, 187, 191, 198, 199, 201, 207, 220, 216, 219, 222, 224, 228, 230, 234, 244, 256, 263, 265, 266, 269, 271, 281, 286, 288, 291, 292, 296, 298, 304, 308, 333, 341, 347, 403, 429, 452, 485, 513, 536, 574 and 755 or of the sequences which exhibit an least 99% identity with the sequences identified in SEQ ID NOs: 1, 2, 3, 4, 5, 7, 8, 9, 10, 11, 12, 13, 14, 15, 16, 17, 18, 19, 20, 21, 23, 24, 25, 26, 27, 29, 31, 32, 33, 34, 36, 38, 39, 40, 41, 42, 43, 44, 45, 46, 47, 50, 51, 52, 53, 57, 58, 59, 61, 63, 64, 65, 68, 70, 71, 72, 74, 75, 76, 77, 78, 79, 80, 83, 84, 85, 86, 87, 88, 89, 90, 91, 92, 94, 96, 97, 102, 104, 106, 107, 109, 110, 115, 116, 118, 121, 122, 123, 127, 132, 133, 136, 137, 142, 147, 148, 150, 159, 160, 162, 163, 164, 165, 166, 167, 170, 171, 175, 182, 187, 191, 198, 199, 201, 207, 210, 216, 219, 222, 224, 228, 230, 234, 244, 256, 263, 265, 266, 269, 271, 281, 286, 288, 291, 292, 296, 298, 304, 308, 333, 341, 347, 403, 429, 452, 485, 513, 556, 574 and 755.

In particular, the kit comprises 2 or 3 respectively specific binding partners of the expression products of the nucleic acid sequences identified in SEQ ID NOs: 1, 26 and 29 or of the sequences which exhibit at least 99% identity, preferably at least 99.5% identity and advantageously at least 99.6% or at least 99.7% identity with the sequences identified in SEQ ID NOs: 1, 26 and 29.

In particular, the kit comprises 1, 2 or 3 specific binding partner (s) of the expression product(s) of the nucleic acid sequences identified in SEQ ID NOs: 1, 26 and 29 or of the sequences which exhibit at least 99% identity, preferably at least 99.5% identity and advantageously at least 99.6% or at least 99.7% identity with the sequences identified in SEQ ID NOs: 1, 26 and 29.

The at least specific binding partner of the expression product corresponds to the definitions given above.

The invention also relates to a method for evaluating the efficacy of a treatment and/or a progression in testicular cancer, which comprises a step of obtaining a series of biological samples, and a step of detecting at least one expression product of at least one nucleic acid sequence in said series of biological samples, said nucleic acid sequence being chosen from the sequences identified in SEQ ID NOs: 1 to 775, with one of the sequences identified in SEQ ID NOs: 1 to 775 or of the sequences which exhibit at least 99% identity, preferably at feast 99.5% identity and advantageously at least 99.6% or at least 99.7% identity with the sequences identified in SEQ ID NOs: 1 to 775. Preferably, the expression product of at least one nucleic acid sequence, preferably of at least two nucleic acid sequences or of three nucleic acid sequences is detected, said nucleic acid sequences being chosen from the group of sequences identified in SEQ ID NOs: 1, 26 and 29.

In one embodiment, at least two expression products of at least two nucleic acid sequences are detected, said two nucleic acid sequences being chosen from the sequences identified in SEQ ID NOs: 1 to 775 or from the sequences which exhibit at least 99% identity respectively, preferably at least 99.5% identity and advantageously at least 99.6% or at least 99.7% identity with the sequences identified in SEQ ID NOs: 1 to 775.

In another embodiment of the method, the expression, product of at least one nucleic acid sequence, preferably of at least two nucleic acid sequences or of three nucleic acid sequences is detected, said nucleic acid sequences being chosen from the group of sequences identified in SEQ ID NOs: 12, 26 and 29 or from the sequences which exhibit at least 99% identity respectively, preferably at least 99.5% identity and advantageously at least 99.6% or at least 99.7% identity with the sequences identified in SEQ ID NOs: 1, 26 and 29.

The term "biological sample" is intended to mean a tissue, a fluid, components of said tissue and fluid, such as cells or apoptotic bodies, and excreted vesicles, comprising in particular exosomes and microvesicles. By way of example, the biological sample may be derived from a biopsy of the testicle carried out beforehand in a patient suspected of suffering from testicular cancer or may be derived from a biopsy carried out on an organ other than the testicle in a patient presenting metastases. In this second case, when the change in expression of the nucleic acid (molecular marker) is specific for the testicular organ, it is possible to work back to the primary cancer, i.e. to testicular cancer. The biological sample may also be a biological fluid, such as blood or a blood fraction (serum, plasma), urine, saliva, cerebrospinal fluid, lymph, maternal milk, sperm, and also components of said fluids, in particular excreted vesicles as defined above. For example, the detection of a transcript specific for the testicular tissue in an exosome or a microvesicle, originating from an epithelial cell, is a sign of the presence either of a primary cancer or of metastases, without it being necessary to take a sample at the level of the organ.

FIGURES

Figure 2:
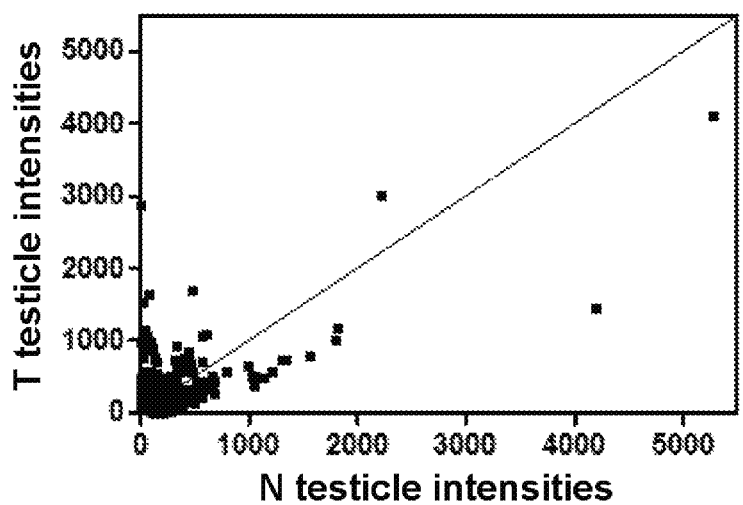

FIGS. 1 and 2 represent the differential expression observed in testicular cancer for a set of HERV sequences. More specifically, FIG. 1 (clustering) groups together in an exploratory manner the HERV elements which have an expression tropism associated with testicular cancer compared with all the control tissues, and FIG. 2 shows the statistical differences in expression of HERV elements between normal testicle and tumoral testicle.

Figure 3:
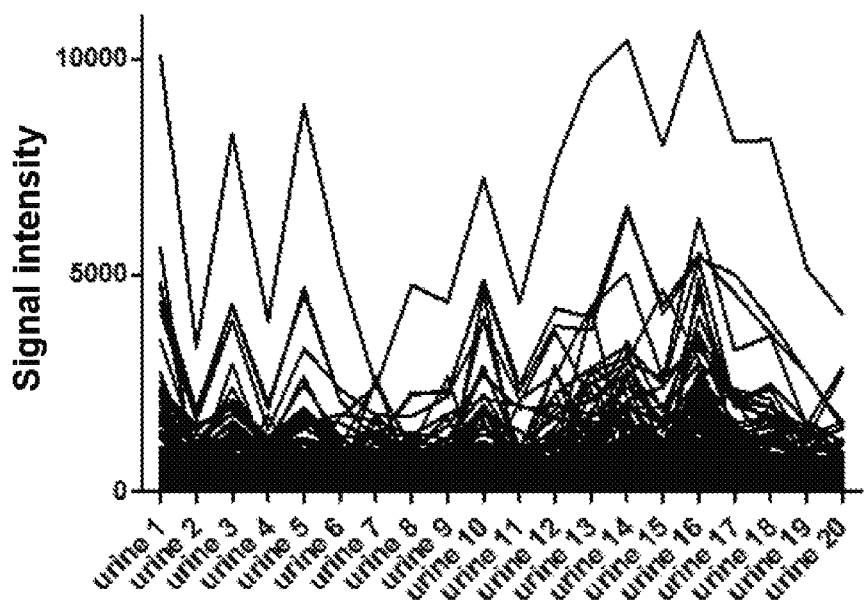
Figure 4:
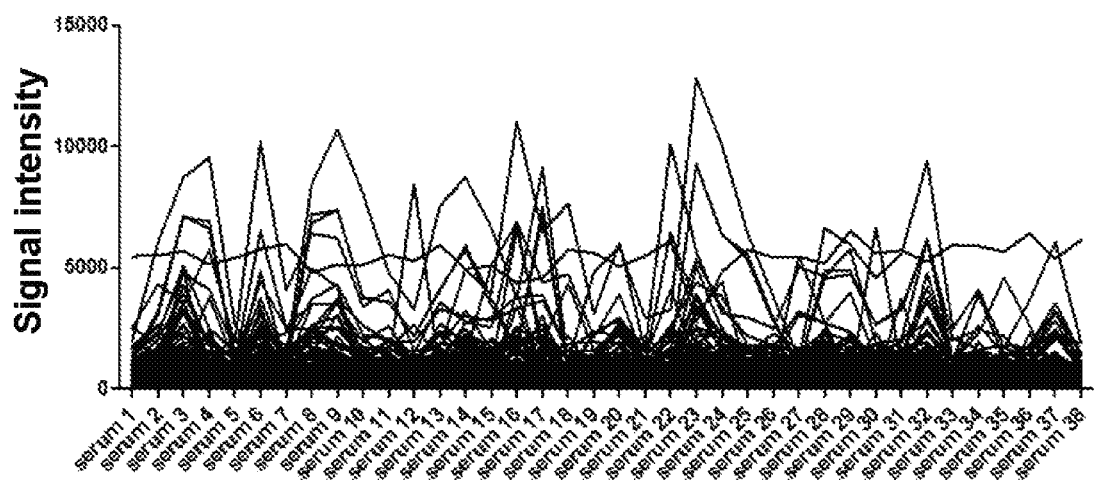

FIGS. 3 and 4 show the detection of HERV sequences in two biological fluids: urines and sera.

EXAMPLES

Example 1

Identification of HERV Sequences Exhibiting Differential Expression in Testicular Cancer Method:

The identification of HERV sequences exhibiting differential expression in testicular cancer is based on the design and the use of a high-density DNA chip in the GeneChip format, called HERV-V2, designed by the inventors and the fabrication of which was subcontracted to the company Affymetrix. This chip contains probes which correspond to HERV sequences that are distinct within the human genome. These sequences were identified using a set of prototypical references cut up into functional regions (LTR, gag, pol and env), and then, by means of a similarity search on the scale of the whole human genome (NCBI 36/hg18), 10 035 distinct HERV loci were identified, annotated and finally grouped together in a databank called HERVgDB3.

The probes which are part of the composition of the chip were defined on the basis of HERVgDB3 and selected by applying a hybridization specificity criterion, the objective of which is to exclude, from the creation process, the probes having a high risk of hybridization with an undesired target. For this, the HERVgDB3sequences were first segmented in sets of 25 overlapping nucleotides (25-mers), resulting in a set of candidate probes. The risk of nonspecific hybridization was then evaluated for each candidate probe by performing alignments on the whole of the human genome using the KASH algorithm (2). An experimental score marks the result of the hybridization, addition of the impact of the number, of the type and of the position of the errors in the alignment. The value of this score correlates with the target/probe hybridization potential. Knowledge of all the hybridization potentials of a candidate probe on the whole of the human genome makes it possible to evaluate its capture specificity. The candidate probes which exhibit good capture affinity are retained and then grouped together in "probe sets" and, finally, synthesized on the HERV-V2 chip.

The samples analyzed using the HERV-V2 high-density chip correspond to RNAs extracted from tumors and to RNAs extracted from the healthy tissues adjacent to these tumors. The tissues analyzed are the testicle, with breast, ovary, uterus, prostate, lung, colon and placenta as controls. In the case of placenta, only healthy tissues were used. For each sample, 50 ng of RNA were used for the synthesis of cDNA using the amplification protocol known as WTO. The principle of WTO amplification is the following: random primers, and also primers targeting the 3' end of the RNA transcript, are added, before a step of reverse transcription followed by a linear, single-stranded amplification denoted SPIA. The cDNAs are then assayed, characterized and purified, and then 2 µg are fragmented, and labeled with biotin at the 3' end via the action of the terminal transferase enzyme. The target product thus prepared is mixed with control oligonucleotides, then the hybridization is carried out according to the protocol recommended by the company Affymetrix. The chips are then visualized and read in order to acquire the image of their fluorescence. A quality control based on standard controls is carried out, and a set of indicators (MAD, MAD-Med plots, RLE) serve to exclude the chips that are not in accordance with a statistical analysis.

The analysis of the chips first consists of a preprocessing of the data through the application of a correction of the background noise based on the signal intensity of tryptophan probes, followed by RNA normalization (3) based on the quantile method. A double correction of the effects linked to the batches of experiments is then carried out by applying the COMBAT method (4) in order to guarantee that the differences in expression that are observed are of biological and not technical origin. At this stage, an exploratory analysis of the data is conducted using tools for grouping together data by Euclidean partitioning (clustering) and, finally, a statistical analysis using the SAM procedure (5) followed by a correction via the rate of false positives (6) and elimination of the values below $2^6$ is applied in order to search for sequences exhibiting a differential expression between the normal state and the tumor state of a tissue.

Results:

The processing of the data generated by the analysis of the HERV-V2 DNA chips using this method made it possible to identify a set of "probe sets" exhibiting a statistically significant difference in expression between the normal testicle and the tumoral testicle. The results of the clustering and also the search for differential expression within the control samples moreover demonstrated HERV elements of which the differential expression is specifically associated with the tumoral testicle.

The nucleotide sequences of the HERV elements exhibiting a differential expression in the tumoral testicle are identified by SEQ ID NOs: 1 to 775, the chromosomal location of each sequence is given in the NCBI reference 36/hg18, and the "target tissue" information (a cross) indicates the elements in which the differential expression was observed only in the comparison between normal testicle and tumoral testicle (compared with the comparisons within the control tissues). A value which is an indication of the ratio of expression between normal state and tumor state is also provided, and serves to order the sequences in the interests of presentation only.

Example 2

Detection of HERV Sequences in Biological Fluids
Principle

The inventors have shown that HERV sequences are detected in biological fluids, which makes it possible, inter alia, to characterize a testicular cancer through recourse to remote detection of the primary organ. A study was carried out on 20 urine samples and 38 serum samples originating from different individuals.

The sera and the urines were centrifuged under the following conditions:

Sera: 500 g for 10 minutes at 4° C. The supernatant was recovered and centrifuged again at 16 500 g for 20 minutes at 4° C. The supernatant of this second centrifugation, devoid of cells, but also comprising exosomes, microvesicles, nucleic acids and proteins, was analyzed on chips. The chip is the HERV-V2 chip used according to the modes previously described.

Urines: after collection, centrifugation at 800 g for 4 minutes at 4° C. The pellet was recovered with RNA protect cell reagent™. Then, centrifugation at 5000 g for 5 minutes before addition of the lysis buffer to the pellet. The chip is the HERV-V2 chip used according to the modes previously described.

Results:

A large number of positive signals, including the expression signals corresponding to the sequences listed in the table above, was detected both in the serum supernatants and in the cell pellets originating from urines, as illustrated in FIGS. 3 and 4. This confirms that biological fluids, in particular serum and urine, are a usable scarce of biological material for the detection of HERV sequences. It is commonly accepted that the positivity threshold is about $2^6$, i.e. 64.

LITERATURE REFERENCES

1. Nickerson, D. A., Taylor, S. L., Weiss, K. M., Clark, A. G., Hutchinson, R. G., Stengard, J., Salomaa, V., Vartiainen, E., Boerwinkle, E. and Sing, C. F. (1998) DNA sequence diversity in a 9.7-kb region of the human lipoprotein lipase gene. *Nat. Genet.,* 19, 233-240.
2. Navarro, G. and Raffinot, M. (2002) Flexible Pattern Matching in Strings: Practical On-Line Search Algorithms for Texts and Biological Sequences. Cambridge University Press.
3. Irizarry, R. A., Hobbs, B., Collin, F., Beazer-Barclay, Y. D., Antonellis, K. J., Scherf, U. and Speed, T. P. (2003) Exploration, normalization, and summaries of high density oligonucleotide array probe level data. *Biostatistics* (Oxford, England), 4, 249-264.
4. Johnson, W. E., Li, C. and Rabinovic, A. (2007) Adjusting batch effects in microarray expression data using empirical Bayes methods. *Biostatistics* (Oxford, England), 8, 118-127.
5. Tusher, V. G., Tibshirani, R. and Chu, G. (2001) Significance analysis of microarrays applied to the ionizing radiation response. *Proceedings of the National Academy of Sciences of the United States of America,* 98, 5116-5121.
6. Storey, J. D. and Tibshirani, R. (2003) Statistical significance for genomewide studies. *Proceedings of the National Academy of Sciences of the United States of America,* 100, 9440-9445.

SEQUENCE LISTING (775 sequences)

SEQ ID NO: 1 - DNA, 9465 bp, Homo sapiens
gtggggaaaagcaagagagatcagattgttactgtgtctgtgtagaaagaagtagacataggagactccattttgttatgtactaagaaaaattcttctgccttgagattctgttaatctataaccttacccccaaccccgtgctctctgaaacgtgtgctgtgtcaactcagagttgaatggattaagggcggtgcaggatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtctctccccatgtgatagtctgaaatatggcctcgtgggaagggaaagacctgaccgtcccccagcccgacacccgtaaagggtctgtgctgaggaggattagtaaaagaggaaggaatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctctttgagaaacacccacagatgatcaataaatactaagggaactcagaggctggcaggatcctccatatgctgaacgctggttccccggttccccttatttctttctctatactttgtctctgtgtctttttcttttccaaatctctcgtcccaccttatgagaaacacccacaggtgtgtaggggcaacccacccctacatctggtgcccaacgtggaggcttttctctagggtgaaggtacgctcgagcgtggtcattgaggacaagtcgacgagagatcccgagtacgtctacagtcagccttacggtaagcttgtgtgctcggaagaagctagggtgataatggggcaaactaaaagtaaaattaaaagtaaatatgcctcttatctcagctttattaaaattcttttaaaaagagggggagttaaagtatctacaaaaaatctaatcaagctatttcaaataatagaacaattttgcccatggtttccagaacaaggaactttagatctaaaagattggaaaagaattggtaaggaactaaaacaagcaggtaggaagggtaatatcattccacttacagtatggaatgattgggccattattaaagcagctttagaaccatttcaaacagaagaagatagcatttcagtttctgatgcccctggaagctgtttaatagattgtaatgaaaagacaaggaaaaaatcccagaaagaaacggaaggtttacattgtgaatatgtagcagagccggtaatggctcagtcaacgcaaaatgttgactataatcaattacaggaggtgatatatcctgaaacgttaaaattagaaggaaaaggtccagaattagtggggccatcagagtctaaaccatgaggcacaagtcctcttccagcaggtcaggtgcccgtaagattacaacctcaaacgcaggttaaagaaaataagacccaaccgccagtagcttatcaatactggccgccggctgaacttcagtatcggccacccccagaaagtcagtatggatatccaggaatgcccccagcaccacagggcagggcgccataccctcagccacccactaggagacttaatcctacggcaccacctagtagacagggtagtgaattacatgaaattattgataaatcaagaaaggaaggagatactgaggcatggcaattcccagtaacgttagaaccgaagccacctggagaaggagcccaagagggagagcctcccacagttgaggccagatacaagtctttttcgataaaaatgctaaaagatatgaaagaaggagtaaaacagtatggacccaactccccttatatgaggacattattagattccattgctcatggacatagactcattccttatgattgggagattctggcaaaatcgtctctctcaccctctcaatttttacaatttaagacttggtggattgatggggtacaagaacaggtccgaagaaatagggctgccaatcctccagttaacatagatgcagatcaactattaggaataggtcaaaattggagtactattagtcaacaagcattaatgcaaaatgaggccattgagcaagttagagctatctgccttagagcctgggaaaaaatccaagacccaggaagtacctgcccctcatttaatacagtaagacaaggttcaaaagagccctatcctgattttgtggcaaggctccaagatgttgctcaaaagtcaattgccgatgaaaaagcccgtaaggtcatagtggagttgatggcatatgaaaacgccaatcctgagtgtcaatcagccattaagccattaaaaggaaaggttcctgcaggatcagatgtaatctcagaatatgtaaaagcctgtgatggaatcggaggagctatgcataaagctatgcttatggctcaagcaataacaggagttgttttaggaggacaagttagaacatttggaggaaaatgttataattgtggtcaaattggtcacttaaaaaagaattgcccagtcttaaacaaacagaatataactattcaagcaactacaacaggtagagagccacctgacttatgtccaagatgtaaaaaaggaaaacattgggctagtcaatgtcgttctaaatttgataaaaatgggcaaccattgtcgggaaacgagcaaaggggccagcctcaggccccacaacaaactggggcattcccaattcagccatttgttcctcagggttttcagggacaacaacccccactgtcccaagtgtttcagggaataagccagttaccacaatacaacaattgtcccccgccacaagcggcagtgcagcagtagatttatgtactatacaagcagtctctctgcttccaggggagcccccacaaaaaatccccacaggggtatatggccccctgcctgaggggactgtaggactaatcttgggaagatcaagtctaaatctaaaaggagttcaaattcatactagtgtggttgattcagactataaaggcaaaattcaattggttattagctcttcaattccttggagtgccattccaggagacaggattgctcaattattactcctgccatatattaagggtggaaatagtgaaataaaaagaataggagggcttgtaagcactgatccaacaggaaaggctgcatattgggcaagtcaggtctcagagaacagacctgtgtgtaaggccattattcaaggaaaacagtttgaagggttggtagacactggagcagatgtctctatcattgctttaaatcagtggccaaaaaattggcctaaacaaaaggctgttacaggacttgtcggcgtaggcacagcctcagaagtgtatcaaagtactgagattttacattgcttagggccagataatcaagaaagtactgttcagccaatgattacttcaattcctcttaatctgtggggtcgagatttattacaacaatggggtgcggaaatcaccatgcccgctccattatatagccccacgagtcaaaaaatcatgaccaagatgggatatataccaggaaagggactagggaaaaatgaagatggcattaaaattccagttgaggctaaaataaatcaaaaaagagaaggaatagggtatcctttttaggggcggccactgtagagcctcctaaacccataccattaacttggaaaacagaaaaaccggtgtgggtaaatcagtggccgctaccaaaacaaaaactggaggctttacatttattagcaaatgaacagttagaaaagggtcatattgagccttcgttctcaccttggaattctcctgtgtttgtaattcagaagaaatcaggcaaatggcgtatgttaactgacttaagggctgtaaacgccgtaattcaacccatggggcctctccaacctgggttgccatctccagccatgatcccaaaagattggcctttaattataattgatctaaaggattgcttttttaccatccctctggcagagcaggattgtgaaaaatttgcctttactataccagccataaataataaagaaccagccaccaggtttcagtggaaagtgttacctcagggaatgcttaatagtccaactatttgtcagacttttgtaggtcgagctcttcaaccagttagagaaaagttttcagactgttatattattcattatattgatgatattttatgtgctgcagaaacgaaagataaattaattgactgttatacatttctgcaggcagaggttgccaatgctggactggcaatagcatctgataagatccaaacctctactccttttcattatttagggatgcagatagaaaatagaaaaattaagccacaaaaaatagaaataagaaaagacacattaaaagcactaaatgattttcaaaaattactaggagatattaattggattcggccaactctaggcattcctacttatgccatgtcaaatttgttctctatcttaagaggagactcagacttaaatagtaaaagaatgttaaccccagaggcaacaaaagaaattaaattagtggaagaaaaaattcagtcagcgcaaataaatagaatagatcccttagccccactccaacttttgatttttgccactgcacattctccaacaggcatcattattcaaaatactgatcttgtggagtggtcattccttcctcacagtacagttaagacttttacactgtacttggatcaaatagctacattaattggtcagacaagattacgaataataaaattatgtggaaatgacccagacaaaatagttgtccctttaaccaaggaacaagttagacaagcctttatcaattctggtgcatggcagattggtcttgctaattttgtgggaattattgataatcattacccaaaaacaaagatcttccagttcttaaaattgactacttggattctacctaaaattaccagacgtgaacctttagaaaatgctctaacagtatttactgatggttccagcaatggaaaagcagcttacacagggccgaaagaacgagtaatcaaaactccatatcaatcggctcaaagagcagagttggttgcagtcattacagtgttacaagattttgatatcaatattatatcagattctgcctatgtagtacaggctacaagggatgttgagacagctctaattaaatatagcatggatgatcagttaaaccagctattcaatttattacaacaaactgtaagaaaaagaaatttcccattctatattactcatattcgagcacacactaatttaccagggcctttgactaaagcaaataaacaagctgacttactggtatcatctgcactcataaaagcacaagaacttcatgctttgactcatgtaaatgcagcaggattaaaaaacaaatttgatgtcacatggaaactggcaaaagatattgtacaacattgcacccagtgtcaagtcttacacctgcccactcaagaggcaggagttaatcccagaggtctgtgtcctaatgcattatggcaaatggatgtcacgcatgtaccttcatttggaagattatcatatgttcatgtaacagttgatacttattcacatttcatatgggcaacttgccacacaggagaaagtacttcccatgttaaaaaacacttattgtcttgttttgctgtaatgggagttccagaaaaaatcaaaactgacaatggaccaggatattgtagtaaagctttccaaaaattcttaagtcagtggaaaatttcacatacaacaggaattccttataattcccaaggacaggccatagttgaaagaactaatagaacactcaaaactcaattagttaaacaaaaagaagggggagacagtaaggagtgtaccactcctcagatgcaacttaatctagcactctatactttaaattttttaaacatttatagaaatcagactactacttctgcagaacaacatcttactggtaaaaagaacagcccacatgaaggaaaactaatttggtggaaagataataaaaataagacatgggaaatagggaaggtgataacgtgggggagaggttttgcttgtgtttcaccaggagaaaatcagcttcctgtttggatacccactagacatttgaagttctacaatgaacccatcagagatgcaaagaaaagcacctccgcggagacggagacaccgcaatcgagcaccgttgactcacaagatgaacaaaatggtgacgtcagaagaacagatgaagttgccatccaccaagaaggcagagccgccaacttgggcacaactaaagaagctgacgcagttagctacaaaatatctagagaacacaaaggtgacacaaaccccagagagtatgctgcttgcagccttgatgattgtatcaatggtggtaagtctccctatgcctgcaggagcagctgcagctaactatacctactgggcctatgtgcctttcccgcccttaattcgggcagtcacatggatggataatcctatagaagtatatgttaatgatagtgtatgggtacctggccccatagatgatcgctgccctgccaaacctgaggaagaagggatgatgataaatatttccattgggtatcgttatcctcctatttgcttagggacagcaccaggatgtttaatgcctgcagtccaaaactggttggtagaagtacctattgtcagtcccatcagtagattcacttatcacatggtaagcgggatgtcactcaggccacgggtaaattatttacaagacttttcttatcaaagatcattaaaatttagacctaaagggaaaccttgccccaaggaaattcccaaagaatcaaaaaatacagaagttttagtttgggaagaatgtgtggccaatagtgcggtgatattacaaaacaatgaatttggaactattatagattgggcacctcgaggtcaattctaccacaattgctcaggacaaactcagtcgtgtccaagtgcacaagtgagtccagctgttgatagcgacttaacagaaagtttagacaaacataagcataaaaaattgcagtctttctacccttgggaatggggagaaaaaggaatctctaccccaagaccaaaaatagtaagtcctgtttctggtcctgaacatccagaattatggaggcttactgtggcctcacaccacattagaatttggtctggaaatcaaactttagaaacaagagatcgtaagccattttatactgtcgacctaaattccagtctaacagttcctttacaaagttgcgtaaagcccccttatatgctagttgtaggaaatatagttattaaaccagactcccagactataacctgtgaaaattgtagattgcttacttgcattgattcaacttttaattggcaacaccgtattctgctggtgagagcaagagagggcgtgtggatccctgtgtccatggaccgaccgtgggaggcctcaccatccatccatattttgactgaagtattaaaaggtgttttaaatagatccaaaagattcatttttactttaattgcagtgattatgggattaattgcagtcacagctacgggtgctgtagcaggagttgcattgcactcttctgttcagtcagtaaactttgttaatgattggcaaaaaaattctacaagattgtggaattcacaatctagtattgatcaaaaattggcaaatcaaattaatgatcttagacaaactgtcatttggatgggagacagactcatgagcttagaacatcgtttccagttacaatgtgactggaatacgtcagatttttgtattacaccccaaatttataatgagtctgagcatcactgggacatggttagacgccatctacagggaagagaagataatctcactttagacatttccaaattaaaagaacaaattttcaaagcatcaaaagcccatttaaatttggtgccaggaactgaggcaattgcaggagttgctgatggcctcgcaaatcttaaccctgtcacttgggttaagaccattggaagtactacaattataaatctcatattaatccttgtgtgcctgttttgtctgttgttagtctgcaggtgtacccaacagctctgaagagacagcaaccatcgagaacgggccatgatgacgatggcggttttgtcaaaaagaaaagggggaaatgtggggaaaagcaagagagatcagattgtcactgtgtctgtgtagaaagaagtagacataggagactccattttgttatgtactaagaaaaattcttctgccttgagattctgttaatctataaccttacccccaaccccgtgctctctgaaacgtgtgctgtgtcaactcagagttgaatggattaagggcggtgcaggatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtaaaagaggaaggaatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctctttgagaaacacccacagatgatcaataaatactaagggaactcagaggctggcgggatcctccatatgctgaacgctggttccccggttccccttatttctttctctatactttgtctctgtgtctttttcttttccaaatctctcgtcccaccttacgagaaacacccacaggtgtgtaggggcaacccacccctaca

SEQ ID NO: 2 - DNA, 7225 bp, Homo sapiens
acagcaaccccctttgggttccctccctttgtatgggagctctgttttcactctatttcactctattaaatcttgcaactgcactcttctggtccacatttgttatggctcgagctgagctttcgctcaccatccaccactgctgtttgccactgtcgcagacccaccgccgactcccatccctctggatccggcagggtgtccgctgagctcctgatacggcgagactcccattgccactcccgatcatgctaaaggcttgccattgttcctgcaacgttaagtgcctgggttcgtcctaatcgagctgaacactagtcactgggttccatggttctcttccgtgacccacggcttctaatagagctataacactcactgcatggcccaagattccattccttggaatccgtgaggccaagaaccccaggtcagagaagacgaggcttgccaccatcttggaagcggcccgccaccatcttggaagtggctcgccaccatcttgggagctctgtgagcaaggacctccggtaacattttggcgaccacgaagggacatccaaagctgtgagtaatattggaccactttagcttgctattctgttctattcttccttagaactggaggaaaatactgggcatctgttggccagttaaaaatgattagcatggtcgccgaacttaagactcaggtgtgaggctatctggggaagggctttctaacaacccccaacccttctactgcggacgtttgtctgcctggagccagcttccactttcaattttcttggggaagccgagggccgactagaggcagaaagctgttgtcccgaactcctggcagtagccggctgagatcatggcacagccagaattctctactcagcagttgcccatgtgtgcgcccctacctttccttctgaagtatacctctggggtcctgactgtgactttcttgaaagcgtagccgcaaaattctcctgacctctgaatctacttcctctgatccctgcctcctaggtactaatggttcagactttcatttcctctagcaagttgtatctccgaagggatctaaggaggctctatgctatgtccttaggcacctaggctataacccagggagtcttatccctggtatccctcccgatttaggtatacagctctcgacatgggcagttatgtgggacccgttccccaccacccttgccagggccccgagtttgtaatggctaagagggagagagggaattagagagagagggggggagagagagacaaagagggagtcatagagaaaaagaaagaaaaagatagaaatagttaaaaaaaaaagtgtgccctattcctttaaaagtcagggtaaatttaaaacctataattgataattgtcactttgttgtcagtgtaaataagggcgtagcaaatccttaacccagtaaccaaggatgggccaaatgcattcagtcggtagcgacaactgctttgctaaaagtagaaaagtaacttttagaggaaacctcgttgtgagcgcacctcaccagttcagagttattctaagtcaaaaaaaagcaaaaaggtagcttactaactcaataatcttaaagtatggggctactatgttagaaaagggtaatgtaactccaaccactgataattcccttaacccatcagatttcctaacaagggatttaaatcttaattaccacacaaaggtccgaccagacctaggaggaactcccttcatgacaggatggtagatggttcctcccaggtgacagatgggtactgaatacaatgggtattcagtcattgatacggagactcttgtggaagcagagttaaaaaattgcctaagaattggtctcctcaaatgtgcgagctgtttgcactcagccaagccttaaagtacttacagaatcaaaagactatctcaatcctgactcaaaaggttagctataccctctctgaaatgaatttgcataagaactgttgtttatgggaatgcatcttgatgggtcagctgggttgttatgaaatactcaggaacccagcccagctctaggactcacccctgagcacaaaggcaatgctgggcatgctggtaaaggaccactagaatccagcagcccggaccgctttctttgtggtcaagaaaggcaggaaaacaggtgcaggactgctacatcggcgagcgtaactaatccgataagcagaggtccatgggtggtgacacaccctggaaaggaactcacctctgagcacaaaggaaatgttgggcacactggtaaaggaccactagaatccagcagcccggacccctttctttgtggtcaagaaaggtgggaaagggagtgcaggactgctacattggtgagcatcactaatctgataagcagaggtccatgggtggttacgcaccctggaaaagaataagcattaggcccttagaggacgctctaggactaatgctcatcggaaaataactaggggtgctggcatccttatgttcttttttcagatgggaaatgttccccccaaggcaaaaatgcccgtaagatgtattctggagaattaggaccaatttgaccctcagacgctaagaaagaaacgacttatattcttctgcagtaccgcctggccacgatatcctcttcaagggggagaaacctggcctcctgagggaagtacaaattataacaccatcttacagctagacctcttttgtagaaaagaaggcaaatggagtgaagtgccatatgtgcaaactttcttttcattaagagacaactcgcaattatgtaaaaagtgtagtttatgccctacaggaagccctcagagtctacctccctatcccagcatccccctgactccttccccaactaataaggaccccccttcaacccaaacggtccaaaaggagataaacaaatgggtaaacaataaatcaaagagtgccaatgttccctgattatgccccttccaagcagtgggaggaggagaattcggcccagccagagtgcatgtacctttttctctttcagacttaaagcaaattaaaatagacctaggtaaattctcagataaccctgatggctatattgatgttttacaagggttaggacaatcctttaatctgacatggagagatataatatcactgctaaatcagacactaaccccaaatgagagaagtgccgccataactgcaacccaagagtttggcgatctctggtatctcagtcaggtcaatgacaggatgacaacagaggaaagagaatgattccccacaggccagcaggcagttcccagtgtagaccctcattaggacacagaatcagaacatggagattggtgccgcagacatttgctaacttgcgtgctagaaggactgaggaaaactaggaagaaggctatgaattattcaatgatgtccacataacacagggaaaggaagaaaattctactgcctttctggagagactaagggaggcattaaggaagcacacctccctgtcacctgactctactgaaggccaactaacttaaaggataagtttatcactcagttagctgcagacattagaaaaaaacttcaaaagtctgccttaggcccagagcaaaacttagaaaccctattgaacttggcaacttcggttttttataatagagatcaggaggagcaggcaaaatgggacaaacgggataaaaaaaaaaggccactgctttagtcatggccctcaggcaagcagactttggaggttctggaacagggaaaagctgggcaaatcgaatgcctaatagggcttgcttccagtgtggtctacaaggacactttaaaaaagattgtccaatagaaataagccaccacctcgtccatgccccttatgtcaagggaatcactggaaggcccactgccccaggggatgaaggtcctctgagtcagaagccactaaccagatgatccagcagcaggactgagggtgcccggggcaagcgccagcccatgccatcaccctcacagagccccaggtatgcttgaccattgagggtcagaagggtaactgtctcctggacactggcgcggccttctcagtcttactttcctgtcctggacaactgtcctccagatctgtcactgtccgaagggtcctaggacagccagtcactagatacttctcccagccactaagttgtgactggggaactttactcttccacatgcttttctaattatgcctgaaagccccactctcttgttagggagagacattctagcaaaagcaggggccattatacatgtgaatataggagaaggaacaactgtttgttgtcccctgcttgaggaaggaattaatcctgaagtctgggcaacagaaggacaatatggacaagcaaagaatgcccgtcctgttcaagttaaactaaaggattccgcctcctttccctaccaaaggcagtaccccctcagacccgagacccaacaagaactccaaaagattgtaaaggacctaaaagcccaaggcctagtaaaaccatgcaatagcccttgcaagactccaattttaggagtacagaaacccaacgggcagtggaggttagtgcaagatctcaggattatcagtgaggctgttgttcctctatacccagctgtacctaacctttatactctgctttcccaaataccagaggaagcagagtggtttacagtcctggaccttaaggatgcatttttctgcatccctgtacatcctgactctcaattcttgtttgcctttaaagatccttcgaacccaacgtctcaactcacctggactgttttaccccaagggttcaaggatagcccccatctatttggccaggcattagcccaagacttgagtcaattctcatacctggacactcttgtccttcggtacagggatgatttaattttagccacctattcagaaatcttgtgccatcaagccacccaagtgctcttaagtttcttcactacctgtggctacaggtttccaaaccaaaggctcagctctgctcataccaggttaaatacttagcgctaaaattattcaaaggcaccagggccctcagtgaggaatgtatctaacctatactggcttatcctcatcccaaaaccctaaagcaactaagaaggttccttggcataacaggtttctgccgaatatggattcacaggtatgacaaaatagccagaccattatatacactaattaaagaaactcagaaagccaatacccatttagtaagatggacacctgaagcagaagtggctttccaggccctaaagaaggccctaacccaagtcccagtgttaagcttgccaatggggcaagacttttctttatatgtcacagaaaaaacaggaatagctctaggagtccttacacaggtccaaaggacaagcttgcaacccatggcatacctgagtaagaaaatagatgtagtggcaaagggttggcctcattgtttacaggtactggtggcagtagcagtcttagtatctgaagcagttaaaataatacagggaagagatcttactgtgtggacatctcatgatgtgaatgacatactcactgctaaaggagacttgtggctgtcagacaactgtttacttaaatatcaggctttattacttgaagggccagtgctgcgactgcacacttgtgcaactcttaaaccagccacatttcttccagacaatgaagaaaagatagaacggaactgtcaacaagtaattgctcaaaactacgccacttgaagggaccttttagaggttcccttgactgatcccgacctcaacttgtatactaatggaagttcctttgtagaaaaaggacttcgaaaagtggggtatgcagtggtcagtgataatggaatacttgaaagtaatcccctcactccaggaactagtgctcagctggcaaaactaatagccctcactcgggcactagaattaggagaaggaaaatgggtaaatatatatacagactctaagtatgcttacctagtcctccatgcccacgcagcaatgtggagagaaagggaattcctaacttctgagggaacacctatcaaacattaggaagccattaggaaattattattcactgtacagaaacctaaagaggtggcagtcttacactgccggggtcatcagaaaggaaaggaaagggaaatagaagggaaccgccaagcgggtattgaagccaaatgacccgcaaggcaggaccctccattagaaatgcttatagaaggacccctaatatggggtaaccccctctgggaaaccaagccctagtactcagcaggaaaaatagaatagggaacctcatgaggacatacttccctccccttcagatggctagccaccgaagaaggaaaaatatttttgcctgcagctaaccaataaaaattacttaaaacccttcatcaaaccttccacttaggcattgatagcacccatcagatggccaaattattatttactggaccaggccttttcaaaactatcaagcagatagtcagggcctgtgaggtgtgccaaagaaataatcccctacactgcaggccatacatttcaatccctgtatctttaacctccttgttaagtttgtctcttccagaattgaaactgtaaaactacaaatggtttttcaaatggagccccagatgcagtccatgactaagatccaccgtggacccctgaaatggcctgctagcccattctctgatgttaatgatgtcgaaggcacccctcccgagaaaatctcaactgcacaacccctactatgccccaattcagcaggaagcagttagagtggtcatcggccaacctccccaacaacacttgggttttcctgttgagagggggtactgagagacaggactagctggatttcctaggctgactaagaatccctaagcctagctgggaaggtgaccgcatccacctttaaacatggtgctcgcaacttagctcccacccaaccaatcagagagctcactaaaatgctaattatgcaaaaacaggaggtaaagaaatagccaatcatctattgcctgagagcacagtgggagggacaaggatcgggacataaacccaggcattcgagccagcaacagcaaccccctttgggtcccctccatttgtatgggagctctgttttcactctatttcactctattaaatcttgcaactgca

SEQ ID NO: 3 - DNA, 2674 bp, Homo sapiens
agtcacatggatggataatcctatagaagtatatgttaatgatagcgaatgggtacctggccccacagatgatcgctgccctgccaaacctgaggaagaagggatgatgataaatatttccattgggtatcgttatcctcctatttgcttagggacagcaccaggatgtttaatgcctgcagtccaaaattggttggtagaagtacctattgtcagtcccatcagtagattcacttatcacatggtaagcgggatgtcactcaggccacgggtaaattatttacaagactttccttatcaaagatcattaaaatttagacctaaagggaaaccttgccccaaggaaattcccaaagaatcaaaaaatacagaagttttagtttgggaagaatgtgtggccaatagtgcggtgatattacaaaacaatgaattcggaactattatagattgggcacctcgaggtcaattctaccacaattgctcaggacaaactcagtcatgtccaagtgcacaagtgagtccagctgttgatagcgacttaacagaaagtttagacaaacataagcataaaaaattgcagtctttctacccttgggaatggggagaaaaaggaatctctaccccaagaccaaaaataataagtcctgtttctggtcctgaacatccagaattatggaggcttactgtggcctcacaccacattagaatttggtctggaaatcaaactttagaaacaagagatcgtaagccattttatactgtcgacctaaattccagtctaacacttcctttacaaagttgcgtaaagcccccttatatgctagttgtaggaaatatagttattaaaccagactcccagactataacctgtgaaaactgtagattgcttacttgcattgattcaacttttaattggcaacaccgtattctgctggtgagagcaagagagggcgtgtggatccttgtgtccatggaccgaccgtgggaggcctcaccatccgtccatattttgactgaagtattaaaaggtgttttaaatagatccaaaagattcatttttactttaattgcagtgattatgggattaattgcagtcacagctacgggtgctgtagcaggagttgcattgcactcttctgttcagtcagtaaactttgttaatgattggcaaaaaaattctacaagattgtggaattcacaatctagtattgatcaaaaattggcaaatcaaattaatgatcttagacaaactgtcatttggatgggagacagactcatgagcttagaacatcgtttccagttacaatgtgactggaatacgtcagatttttgtattacaccccaaatttataatgagtctgagcatcactgggacatggttagacgccatctacagggaagagaagataatctcactttagacatttccaaattaaaagaacaaattttcgaagcatcaaaagcccatttaaatttggtgccaggaactgaggcaattgcaggagttgctgatggcctcgcaaatcttaaccctgtcacttgggttaagaccattggaagtactacgattataaatctcatattaatccttgtgtgcctgttttgtctgttgttagtctgcaggtgtacccaacagctccgaagagacagcgaccatcgagaacgggccatgatgacgatggcggttttgtcgaaaagaaaagggggaaatgtggggaaaagcaagagagatcagattgttactgtgtctgtgtagaaagaagtagacataggagactccattttgttatgtgctaagaaaaattcttctgccttgagattctgttaatctataaccttacccccaaccccgtgctctctgaaacgtgtgctgtgtcaactcagagttaaatggattaagggcggtgcaggatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacaccaagggtctgtgctgaggaggattagtaaaagaggaaggaatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctcttcgagaaacacccacaagtgatgaataaatactaagggaactcagaggctggcgggatcctccatatgctgaacgctggttccccggttccccttatttctttctctatactttgtctctgtgtctttttcttttccaaatctctcgtcccaccttacgagaaacacccacaggtgtgtaggggcaacccacccctaca

SEQ ID NO: 4 - DNA, 2671 bp, Homo sapiens
agtcacatggatggataatcctatagaagtatatgttaatgatagcgaatgggtacctggccccacagatgatcgctgccctgccaaacctgaggaagaagggatgatgataaatatttccattgggtatcgttatcctcctatttgcctagggagagcaccaggatgtttaatgcctgcagtccaaaattggttggtagaagtacctactgtcagtcccatcagtagattcacttatcacatggtaagcgggatgtcacttaggccacgggtaaattatttacaagacttttcttatcaaagatcattaaaatttagacctaaagggaaaccttgccccaaggaaattcccaaagaatcaaaaaatacagaagttttagtttgggaagaatgtgtggccaatagtgcggtgatattacaaaacaatgaattcggaactattatagattgggcacctcgaggtcaattctaccacaattgctcaggacaaactcagtcgtgtccaagtgcacaagtgagtccagctgttgatagcgacttaacagaaagtttagacaaacataagcataaaaaattgcagtctttctacccttgggaatggggagaaaaaggaatctctaccccaagaccaaaaataataagtcctgtttctggtcctgaacatccagaattatggaggcttactgtggcctcacaccacattagaatttggtctggaaatcaaactttagaaacaagagatcgtaagccattttatactgttgacctaaattccagtctaacagttcctttacaaagttgcgtaaagcccccttatatgctagttgtaggaaatatagttattaaaccagactcccagactataacctgtgaaaattggagattgcttacttgcattgattcaacttttaattggcaacaccgtattctgctggtgagagcaagagagggcgtgtggatccctgtgtccatggaccgaccgtgggaggcctcactatccgtccatattttaactgaagtattaaaaggtgttttaaatagatccaaaagattcatttttactttaattgcagtgattatgggattaattgcagtcacagctacggctgctgtagcaggagttgcattgcactcttctgttcagtcagtaaactttgttaatgattggcaaaagaattctacaagattgtggaattcacaatctagtattgatcaaaaattggcaaatcaaattaattgatcttagacaaactgtcatttggatgggagacagactcatgagcttagaacatcttttccagttacagtgtgactggaatacgtcagatttttgtattacaccccaaatttataatgagtctgagcatcactgggacatggttagacgccatctacagggaagagaagataatctcactttagacatttccaaattaaaagaacaaattttcgaagcatctaaagcccatttaaatttggtgccaggaactgaggcaattgcaggagttgctgttggcctcgcaaatcttaaccctgtcacttgggttaagaccattggaagtactacgattataaatttcatattaatccttgtgtgcctgttttgtcagttgttagtctgcaggtgtacccaacagctccgaagaggcagcgaccatcgagaacgggccatgatgacgacggtggttttgtcgaaaagaaaagggggaaatgtggggaaaagcaagagagatcagattgttactgtgtctgtgtagaaagaagtagacataggagactccattttgttatgtactaagaaaaattcttctgccttgagattctgtgaccttacccccaaccccgtgctctctgaaacatgtgctgtgtcaactcagagttaaatggattaagggcggtgcaagatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtaaaagaggaaggaatgcctcttgcagttgagacaagaggaaggcatctgtctcctgcctgtccctgggcaatggaatgtctcggtataaaacccgattgtatgctccatctactgagatagggaaaaaccgccttacggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctcttcgagaaacacccacagatgatcaataaatactaagggaactcagaggctggcgggatcctccatatgctgaacgctggttccccgggtccccttatttctttctctatactttgtctctgtgtctttttcttttccaaatctctcgtcccaccttacgagaaacacccacaggtgtgtaggggcaacccacccctaca

SEQ ID NO: 5 - DNA, 3525 bp, Homo sapiens
gtcaggcctctgagcctaagccaagccatcgcatcccctgtgacttgcacatatacgcccagatggcctgaagcaactgaagaatcacaaaagaagtgaatatgccctgccccaccttaactgatgacattccaccacaaaagaagtgtaaatggccggtccttgccttaactgatgacattaccttgtgaaagtccttttcctggctcatcttggctcaaaaatcacccccactgagcaccttgcgacccccccactcctgcccgccagagaacaaaccccctttgactgcaattttcctttacctacccaaatcctataaaacggccccacccttatctccctttcctgactcttttcggactcagcccgcctgcacccaggtgaaataaacagccatgttgctcacacaaagcctgtttggtggtctcttcatacagacgcgcatgaaatttggtgccgtgactcggatcgggggacctcccttgggagatcaatcccctgtactcctgttctttgctccgtgagaaagatccacctatgacctcaggtcctcagaccgaccagcccaaggaacatctcaccaattttaaatcaggtaagtgtcctcttcttactctcttctccaacctctctcactgtccctcaaccactttctcctttccactcttcaatctctcccttttcttaatttctattcctttcattttctgggaaagacaaaggagacacattttatccatggacccaaaactcctgcgccggtcacggactgggaaggcagccttcccttggtgtttaatcattgcagggacacctctctgattatacactcacgtttcaagggtgtcagaccacacagggacacctgccttggtccttcacccttagcagcaagtcccgcttttctggggaaggggcaagtaccccaaccccttctctccttgtctctaccccttctctgcttttctgggacaggggcaagtacccctcaaccccttctccttcacccttagcggcaagtcccgcttttctatggggtaagaacccccaatcccttatttccgtgccccaacctcttatatctctgcaccccaatcccttatttccgcaccccaacctcttatctctgtgccccaaccccttttcccacttttctggaaggtaagaacccccgaaccccttccctccatttctctactctctcttttctctaggcttgcttccttcactatgggcaaccttccaccctccattcctccttctactcccttggcctgtgttctcaaaaacttaaaacctcttcaactcacacctgacctaaaacctaaatgccttattttcttctgcaatgccgcttgaccccaatacaaactcgacagtagttccaaatagccagaaaatggcactttgaatttttccatcctgcaaaatctaaataattcttgtcgtaaaataggcaaacggtctgagatgcctgacatccaggcattcttttacacatcagtccctccctagtctctgtgcccagtgcaactcgtcccaaatcttccttctttccctcccgcctgtcccgtcagtaccaaccccaagcgtcgctgagtctttctaatcttccttttctacagacccatctgacctctcccctcctccccaggctgctcctcgccaggctgagctaggtcccaattcttcctcagcctctgctcctccaccctataatccttttatcacctcccctcctcacacctggtccggcttacagtttctttccttgactagccctcccccacctgcccagcaatttactcttaaaaaggttcctggagctaaagacataatcaaggttaacgctcctttttctttctcccaaatcagaagtgtttaggctctttttcatcaaatataaaaatccagcccagttcatggctcgttcggcagcaaccctgggacactttacagccctagaccctaaaaggtcaaaaggccgtcttattctcaatatacattttattacccaatctgctcctgacattaaataaaactccaaaaattggaatctggccctcaaaccccacaacaggacttcattaacctcaccttcaaggtgtacaataacagaaaaaagttgcaattctttgcctccactgtgagacaaaccccagccacatctccagcacacaagaacttccaaacgtctgaaacgcagcagccaggcattcctccagaacctcctcccccaggagcttgctacacatgctggaaatctggccactgggccaaggaatgcctgcagcctgggattcctcctaagccacgtcccatctgtgtaggacaccactgaaaatcggactgttcaactcacctggcagccactcccagagcccctggaactctggcccaaggctctctgactgactccttcccagattttctcagcttagcagctgaagactgacgctgccggatcgcctcggaagccccctagaccatcacggacgccgagcttccggtaactctcacagtggaaggtaagcccgtccccttcttaatcaatacagaggttacccactccacattaccttcttttcaagggcctgtttcccttgcctccataactgttgtaagtactgatggccaggcttctaaacctcttaaaactccccaactctggtgccaacttagacaatactctttcaagcactcctttttagttatccccacctgcccagttcccttattaggctgagacactttaactaaattatctgcttccctgactactcctggattacagctatatctcattgccgcccttcttcccaatccaaagcctcctttgcgtcctcctcttgtatccccccaccttaacccacaagtataagatacctctactccctccttggtgaccgatcatgcaccccttaccatctcattaaaacctaatcacccttaccccactcaacgccaatatcccatcccgcagcacgctttaaaaagattaaagcctgttatcactcgcctgctacagcatagccttttaaagcctataaactctccttacaattcccccattttacctgtcctaaaaccagacaagccttacaagttagttcaggatctgcgccttagcaaccaaattgttttgcctatccaccctgcagtgcccaacccgtacactcttttgtcctcaataccttcctccacaactcactgttccgtgcttgatcttaaagatgcttttttcactattcccctgcacctctcgtcccagcctctcttcgctttcacttagactgaccctgacacccattaggctcagcaaattacctaggctgtactgctgcaaggcttagtagacagcccccattacttcagtcaagcccaaatttcatcctcatctgttacctatctcggcataattctcataaaaacacacgtgctctcccagctgattgtgtcccattaatctcccaaacttcaatcccttacaaaacaactcctttccttcctaggcatagttag

SEQ ID NO: 6 - DNA, 5636 bp, Homo sapiens
gtcaggcctctgagctcaagctaagccatcatatcccctgtgacctgcaggtacacatccagatggcccgttcctgccttaactgacgacattccaccacaaaagaagtgaaaatggtctgttcctgccttaactgatgacattgtcttgtgaaattccttctcctggctcatcctggctcaaaacctcccccactgagtagcttgtgacccccactctgcctgccagagaacaaccctcctttgactgtaattttcctttacctacccaaatcctataaaacggccccaccccatctccctttgctgaccctcttttcagactcagcccacctgcacccaggtgaaataaacagccatgttgctcacacaaagcctgtttggtcgtctcttcacacagacacgcatggtgccatgactcggatcagagacctcccttgggagatcaatcccatgtcctcctgttgtttgctccgtgaaaacgatccacctacaacctcaggtcctcagacccaccagcccaaggaacatctcaccaattttaaatctggtaagcagcctcttcttacactcttctccaacctgtctcactgtccctcaaccactttctcctttccactcttcaatctctcccttctcttgatttcaattcctttcattttctggtagagacaaaggagacacgttatatccgtggacccaaaactccggcgctggtcatggactgggaaggcagccttcccttggtgtttaatcattacagggatgcctctctgaatattcccccatgtttcaaaggtgtcagaccacgcagggacgcctgccttggtccttcaaccttagcggcaagtcccgcttttctgggggaggggtaagtaccccaaccccttctctccatgtctctaccccttctctgcttttctgggggaggcacaagtaccccaatctcgtatctctacaccccaatcccttatttccaagcccctacctcttatctctgcaccccaatcccttatttccgcaccctgacctcttatatctctgtaccccgatctcttatttccatgcctggaccttgtatctctgcatcccgacccctttcccacttttctggagggtaagaacccccgaaccgcttccctccatgtctctactctctcttttttctgggcttccttccttcactatgggcaaccttccaccctccattcctccttcttctcccttagcctgtgtttttaagaacttaaaacctcttcaactctcacctgacctaaaatctaagcatcttatttcttctgcaatgctgcttgaccccaaaacaaactcaacagtagttccaaatagccagaaaatggcactttcaatttttccatcctgcaagatctaaataattcttgtcgtaaaataggcaaatggtctgaggtgcctgacgtccaggcattcttttacacatcggtcccttcctagtctctgtgcccaaagcaactcatcccaaatcttcctcctttccctcccacctgtcccctcagtcccaaacccaagcatcgctgagtctttctaatcttccttttctacagacccatctgacctctcccctcctccccaggctgctcctcgccaggccgagctaggtcccaattcttcctcagcctccactcctccaccctacaatccttttatcacctcccctcctcacacccggtctggtctacagtttcattccatgactagccctcccccacctgcccagcaatttactcttgaaaagttgcctggagctaaagacatagtcgaggttaatgctcttttttctttatcctaaatcagatagcatttagcctctttttcatcaaatataaaaatccagcccagttcatggctcgttcagcagcaaccctgagacactttacagccctagaccctaaaaagtcaaaaggccatgttattctcaatatacattttatttcccaatctgctccctacattaaataaaactccaaaaattaaattctggccctcaaaccccacaacagtatttaattaacctcgccttcaaggtgtacaataatagaaaaaaagctgtaattccttacctccactgtgagacaaaccccagccacatctccagcacacaagaacttccaaatgcctgaaccgcagtggccaggcgttactccagaaccttctcccccaggagcttgctacaagtgccagaaatctgactaccaggccaaggaatgcctgcagcccaggattcctcctaagccgcgtcccatctgtgcgggactccactggaaatcggactgtccaactcacctggcagccactcccagagcccctggaactctggcccaagcctctctgactgatcccttctcggcttagcggctgaagactgacgctgccttattgcctcggaagccccgtagaccatcacggacgccgagctttaggtaactctcacagtggaaagtaagttcatccccttcttaatcaatacggaggctccccactccacattaccttcttttcaagggcctgtttcccttgcctccataactgttgtgggtattgacggccaggcttctaaacctcttaaaactccccaagtcttgtgccaacttagacaaaactcttttaagcactcctttttagttatccccacctgcccagttcccttattaggccgaaacactttaactaaattatctgcttccctgactattcctgggctacagccacaccgcattgtgaccttttcccccagttcaaagcccccttcacatcctcctcttgtatctccccaccttaatccgcaagtataggatacctctactccctccttgttgacctatcatgcaccccttaccatctgattaaaacctaatcacccttaccccactcaacgccaatatcccatcccacagcatgctttgaaaggattaaagcctgttatcactcgcctgctacagcatggccttttaaagcctataaactctccttacaattctcccattttacctgtcctaaaaccagacaagccttacaagttagttcaggatttgcctcttatcaacaaaattgttttgcctatccaccccatggtgccaaacacacatactctcctatcctcaatacctccctcaacaacccattattctgttctggatctcaaacttggtatctttactattcctttgctcctgtcatcccagcctctcttcactttcacttggactgaccctgacacccatcaggctcagcagattacctgggctgtactgccgcaaagcttcacagacagcccccattacttcagtcaagcccaaatttcatcctcatctgttacctatctcagcataattctcataaaaacacacgtgctctccctgctgatcgtgtctgattaatctcccaaacctcaatcccttacaaaacgacaactcctttccttcctaggcatggttagcgtggtcagaattcttacacaagagccaggaccgcaccctgtagcctttctgtccaaatagcttgaccttactgttttagcctagccctcacgtctctgtgcagcggctgctgccgccctaatacttttagaggccctcaaaatcacaaactatgcacaactcactctctacatttctcataacttccaaaatctattttcttcctcacacctgatgcacttactgtctgctccccggctccttcagctgtactcactctttgttaagtcccacaattaccattgttcctggcccggacttcagtccggcctcccacattattcctgatactacacctgacccccatgactgtatctctctgatccaactgacattcacctcatttccccatatttccttctttcctgttcctcaacctgatcactcttgatttattgacggcagctccaccaggcctaatcaccacacaccagcaaaggcaggctatgctatagtacaagccactagccctcctcttagaacctctcattttctttccatcgtggaaatctatcctcaaggaaataacttctcagtgttccatctgctattctactactcctcagggattattcaggctccctcccttccctacacatcaagctcagggatttgcccgcacccaggactggcaaattagttttactcaacgtaccccgagtcagataactaaagtacctcttaatctaagtagacactttcactggataagtacaggcctttcctacagggtctgagaaggccaccacagtcatttcttcccttctgtcagacataattcctcagtttagccttcccacctctatacagtctgacaacagaccagcctttattagtcaaatcagccaagcagtttttcaggctcttagtattcagtgaaatctttatatcccttacagtcctcagtcttcaggaaaagtagaacagactaatggtcttttaaaaacacacctcactaagctcagcctccaacttaaaaaggactgtacaacacttttaccactttcccttctcagaagtcagagctgtcctcagaatgctacaaaatacagcccatttgagctcctgtaaagacgctcctttttattggccccagtgtcattccagacaccagaccaacttagactgtgccccaaaaaacttgtcatccctactatcttctgtctagtcaaactcctatttgccgttctcaactactcatacatgcccttctcttgtttacactgccggtttacactgtttctccaagtcatcacagctgatatctcctggtgctatccccaaactgccactcttaactcttgaagtaaataaacaatctctgctgacaggactatgctgaacctccttaggcactctctaattagatgtcctaggtcctcccaattcttagacctttaatatctgtttttctccttctcttcttccatttagtttttcaattcatacaaaactgtatccaggacatcaccaataattctaaatgacaaatgtttcttctaacaaccctacaatatcaccccttaccacaaaatcttccttcagcttaatctctcccactctaggttcccacgccgcccctaatcccgctcgaagcagccctgagaaacatcgcccattgtctctccataccacccccaaaaaattttcaccatcccaacactttaccactattttgttttatttttcttgttaatataagaagacaggaacgtcaggcctctgagcccaagctaagccatcatatcccctgtgacctgcacgtacacatccagatggccggttcctgccttaactgatgacattccaccacaaaagaagtgaaaatggcctgttcctgccttaactgatgacattgtcttgtgaaattccttctcctggctcatcctggctcaaaacctcccccactgagtacattgtgatccctactctgcccgccagagaacaacccccctttaactgtaattttcctttacctaccgaaatcctataaaacggccccacccctatctcccttcactgactctcttttcagactcagcctgcctgcccccatgtgaaataaacagctttattgctcacacaaagcctgtttggtggtctcttcacacggacgtgcatgaaa

SEQ ID NO: 7 - DNA, 5717 bp, Homo sapiens
gtcaggcctctgagcccaagccaagccatcgcatcccctgtgacttgcacgtattcgcccagatggcctgaagtaactgaagaatcacaaaagaagtgaatatgccctgccccaccttaactgatgacattccaccacaaaagaagtgtaaatggctggtccttgccttaagtgatgacattaccttgtgaaagtccttctcctggctcatcctggctcaaaaagcacccctactgagcaccttgcgacccccactcctgcccgccagagaacaaaccccttttgactggaattttcctttacctacccaaatcctataaaacggccccacccttatctcccttcgctgactctcttttcggactcagcccgcctgcacccaggtgaaataaacagccatgttgctcacacaaagcctgtttggtggtctcttcacacggacgtgcatgaaatttggtgccgtgattcagatcgggggacctcccttgggagatcaattccctgtcctcctgttctttgctccatgagaaagatccacctacgacctcaggtcctcagactgaccagcccaaggaacatctcaccaattttaaatcaggtaagcagcctcttcttactctcttctccaacctctctcactgtccctcaaccactttctcctttccactcttcaatctctcccttaatttcaattcctttcattttctgggagagacaaaggagacacattttatccgtggacccaaaactccggcacgggtcatggactgggaaggcagccttcccttggtgtttaatcattgcagggacgccgctctgattatttacccacgtttcaaaggtgtcagaccacgcagggatgcctgccttggtccttcacctttagcggcaagtcctgcctttctgggaaaggggcaagtaccccaaccccttctctccttgtctctaccccttctctgcttttctgggggaggggcaagcaccccaacctcatatctctgcgccccaatcccttatttctgcaccccaatcccttatttctgcgccccgacctcttgtatctctgtgccccggccccttatctccgtgccccggccccttatttctgcgccccatcccttatttccgcaccccgacctcttatctctgtgccccaaccccttttcccacttttctggaaggtaagaacccccaaacccattccctccatttctctactctctcttttctctaggcttgcttccttcactataggcaagcttccaccctccattcctccttctactcccttggcctgtgttctcaaaaacttaaaagctcttcaactcacacctgacctaaaacctaaatgccttattttcttctgccatgccgcttgaccccaatacaaactggacagtagttccaaatagccagaaaatggcactctgaatttttccatcctgccagatctaaataattcttgtcgtaaaataggcaaacggtctgaggtgcctgatgtccagacattcttttacacatcagtcccttcctagtctctgtgcccagtgcaactcgtcccaaatcttccttctttccctcccgcctgtaccctcagtaccaaccccaagcattgctgagtctttctaatcttccttttctacagaccaatctgacctctcccttcctccccaggctgctcctcgccaggctgagctaggtcccaattctacctcagcctctgctcctccaccctataatctttttgtcacctcccctcctcacacctggtccggcttacagtttcgttcagtgactatccctccccatcctgcccaacaatttactcttaaaaaggtggctggagctaaaggcatagtcaaggttaatgctctttttctttatcccaaatcagatagcgtttaggctctttttcatcaaatataaaaatccagcccagttcatggctcgtttggcagcaaccctgagacactttacagccctagaccctaaaaggtcaaaaggccgtcttattctcaaaatacattttattacccaatctgctcccgacattaaataaaactccaaaaattaaattccggccctcaaaccccacaacaggatttaattaacctcgccttcaaggtgtacaatagaaaaaagttacaattccttgcctccactgtgagacaaaccccagccacatctccaacacacaagaacttccaaacgcctgaaccgcagcagccaggcgttcctccagaacctcctcccccaggagcttgctacatgtgccggaaatctggccactgggccaaggaatgcccgcaggccgggattcctcctaagctgtgtcccatctgtgtgggaccccactgaaaatcggactgttcaactcacgtggcagccattcccagagcccctggaactctggcccaaggctctctgactccttcccagatcttctcggcttagcggctgaagaccgacactgcccgatcacctcggaagccccctagaccattatggacgccaagctttgggtaactctcacagtggaaggtaggcccgtccccttcttaatcaatatggaggctacccactccacattaccttcttttcaagggcctgtttcccttgcctccataactgttgtgggtattgacagctaggcttctaaacttcttaaaactccccaactctggtgccaacttagacaatactcttttaagcactcctttttagttacccccacctgcccagttcccttattaggctgagacactttaactaaattatctgcttccctgactattcctgggctacagccacacctcattgctgccttttcccccagttcaaagcctccttcacatcctccccttgtatctccccaccttaacccacaagtataagatacctctactccctccttggcgaccgaccatgcaccccttaccatctcattaaaacctaatcacctttaccccactcaacgccaatatcccatcccgcagcacgctttaaaaagattaaagcctgttatcactcgcctgctacagcatgtccttttaaagcctataaactctccttacaattcccccattttacctgtcctaaaaccagacaagccttacaagttagttcaggatctgcaccttatcaaccaaattgttttgcctgtccaccccgtggtgccaaacccatatactctcctatcctcaatacctgcctctacaacccactattctgttctagatctcaaacatgctttctttactattcctttgcacccttaatcccagcctctcttcactttcacttggactgaccctgacacccatcaagcttagcaaattacctaggctgtactgccgcaaagcttcacagacagcccccgttacttcaatcaagcccaaatttcttcctcatctgttacctatctcggcataattctcataaaaacacacgtgctctccctgcaatcgtgtccgactgatctctcaaacccaagcaccttctacaaaacaacaactcctttccttcctaggcatggttagcgcggtcagaattcttacacaagagccaggaccacaccctgtagcctttatgtccaaacaacttgaccttactgttttagcctagccatcatgtctgggtgcagcggctgccgctgctttaatacttttagaggccctcaaaatcacaaactatgctcaactcactctctacagttctcataacttccaaaatctattttcttcctcatacctgacgcatatactttctgctccccggctccttcagctgtactcactctttgttgagtctcccacaattaccgttgttgctggcccagacttcaatccggcctcccacattattcctgataccacacctgacccccatgactgtatctctctgatccacctgacattcaccccatttccccaaatttccttctttcctgttcctcaccctgatcatgcttgatttattgatggcggttccaccaggcctaatcaccacacaccagcaaaggcaggttatactatagtacaagccactagcccgcctcttagaacctctcatttcctttccatcgtggaaatctatcctcaaggaaataacttctcagtgttccatctgctattccactactcctcagggattattcaggccccctcccttccctacacatcaagctcgaggatttgccccacccaggactggcaaattagctttactaaacatgccctgagtcagataactaaaatacctcttagtctaggtagatactttcactggataggtagaggccttttctacagggtctgagaaggccacggcagtcatttcttccattctgtcagacataattcctcagttaagccttcccacctcaatacagtctgataacagatgagcctttattagtcaaatcagccaagcagtttttcaggctcttagtattcagtgaaacctttatatcccttacggtcctccgtcttcaagaaaagtagaatggactaaaggtcttttaaaaacacacctcaccaagttcagccaccaaaaaggactggacaatacttttaccactttcccttctcagaattcaggcctgtcctcggaatgctacagggtacagcccatttaagctcctgtatagacgctcctttttattaggccccagtctcattccagacaccagaccaacttagactgtgcccccaaaaacttgtcatccctactatcttgtcaagtcatactcctattcaccgttctcaactactcatacatgccctgctcttgtttacactgtttttccaagccatcacagctgatatctcctggtgctatccccaaactgccactcttaacccttgaagtaaataaataatctttgctggcaggactatgctgaatctccttaggcactctctaatcagatatcctgagtagtcccaattcttagaccttttatacctgtttttctccttctgttattccatttagtttttcaattcatccaaaaccgtatccaggccatcaccaatcattctatacgacaaatgtttcttctaacaaccccacaatatcaccccttaccacaagacctgcctccagcttaatctctcccactctaggttcccacgccgcccctaatcctgcttgaagcagccctgagaaacatcgcccattctctctccataccaccccccaaaaattttcgccgccccaacacttcaacactattttatttttcttattaatataagaaggcaggaatgtcaggcctctgagcccaagccaagccatcgcatcccgtgacttgcacgtatacacccagatggcctgaagtaactgaagaatcaaaagaagtgaatatgccctgccccaccttaactgatgacattccgccacaaaagaagtgtaaatggctggtctttgccttaagtgatgacattaccttgtgaaagtccttctcctggctcatcctggctcaaaaaacacctccattgagcaccttgcgacccccactcctgcccaccagagaacaaaccccctttgactgtaattttcttttacctacccaaatcctgtaaaacggccccacccttatctcccttcgctgactctcttttcagactcagcccgcctgcacccaggtgaaataaacagccatgttgctcacacaaagcctgtttggtggtctcttcacacggatgcacatgaaa

SEQ ID NO: 8 - DNA, 5946 bp, Homo sapiens
gtcaggcctctgagcccaagccaagccatcgcatcccctgtgacctgcacgtatacgcccagatggcctgaagtaactaaagaatcacaaaagaagtgaatatgccctgccccaccttaactgatgacattccaccacaaaagaagtgtaaatggccggtccttgccttaactgatgacattaccttgtgaaagtccttttcctggctcatcctggctcaaaaagctcccccactgagcaccttgcgacccccactcctacccaccagagaacaaaccccctttgactgtaattttcctttacctacccaaatcctataaaacggccccacccttatctcccttcgctgactctcttttcggactcagcccacctgcacccacgtgaaataaacagctttattgctcacacaaagcctgtttggtggtctcttcacacggacgcgcgtgaaatttggtgccgtgactcggatcgggggacctcccttgggagatcaatcccctgtcctcctgctctttgctccgtgagaaacatccacttacgacctcaggtcctcagaccgaccagcccaagaaacatctcaccaatttcaaatctggtaagcggcctctttttactctcttctccaacctccctcactatccctcaacctctttctcctttcaatcttggcgccacacttcaatctctcccttctcttaatttcaattcctttcattttctggtagagacaaaagagacacgttttatccgtgaacccaaaactccggcgccggtcacggactgggaaggcagccttcccttggcgtttaatcattacagggacgcctctctgattatacactcacatttcaagggtgtcagaccacgcagggacgcctgccttggtccttcaccctcagcggcaagtcccgctttcctagggggcaagaaccccccaatcgcttatttccgcaccccaacctcttatctctgcgccccaatcccttatttccacaccctgacctcttatctgtgtgccccaatcccttatttccgtgccccaaccccttctctgctttcctggagggcaagaaccccccaccccttctccgtgtctctactcttttctctgggctttcctccttcactataggtaagtttccaccttccattcctccttctcccttagcctgtgttctcaaaaacttaaaacctcttcaactcacacctgacctaaaacctaaatgccttattttcttctgcaatgccgcttgaccccaatacaaactggacagcagttccaaatagccggaaaacggcactttcaatttttccatcctgcaagatctaaataattcttgtcgtaaaatgggcaaatggtctgaggtgcctgacgtccaggcattcttttacacatcagtcccttcctagtctctgtgcccagtgcaactcgtcccaaatcttccttctttccctcccgcctgtcccctcagtaccaaccccaagcgtcgctgagtctttctaatcttccttttctacagacccgtctgacctctcccctcctcgccaggccgagctaggtcccaattcttcctcagcctccgctcctccaccctataatccttctaccacctcccctcctcacacccggcccggcttacagtttagttccgcgactagctcctccccacctgcccaagaatttcctcttagagaggtggctggagctgaaggcagtcagggtacatgtacctttttctctatcacgcctctctcagatcagtcaacgtttaggcactttctcatcagaccccactaaacatatacaggaattccaatatctaactctgtcctacaacaacctggagtgacttaaatgtcatcctgacttctaccctctccccagatgaacgggaaagagtttgttctctagcccaatctcatgctgctaaccactggcttcatgagccagacctccaggaaggcattagagcagttccccgagaggatccccagtggaactaccaggcaaattccccaggtatagctaggcgagattacatggtttcctgcctagttgaagggcttaaaaaagcagcttacaaagctgttcattatgacaaacttaaagaaactacccaaggtaaagatgaaaacccagcccaggtcatggctcgtttggcagcaacctttagacgctataccgccctagaccctaaaaggtcaaaaggccgtcttattctcaacatacattttattacccaatctgctcccgacatgaaataaaactccaaaaactggaatctggccctcgaaccccacaacgggacttaattaacctcaccttcaaggtgtgtaataacagaaaaaagttgcaattccttgcctccactgtgagacaaaccccagccacatctccagcacacaagaacttccaaatgcctgaactgtagcagccaggcgttcctccagaaccttcttcccccaggaacttgctacacatgctggaaatctggccactgggccaaggaacgcccgcagcccgggattcctcctaagccgcgtcccatctgtgtgggaccccactgaaaatcggactgttcaactcacctggcagccactcccagagcccctggaactctagcccagggctctctgactgactccttctcggcttaccggctgaagactgatgctgcctgatcgcctcagaagccccgtagaccatcacggatgccgagctttaggtaactcacagtggagggtaagtctgtccccttcttaatcagtacggaggctacccactccacattaccttcttttcaagggtctgtttcccttgcctccataactgttgtgggtattgacagccaggcttctaagcctcttaaaactcccccaattctggtgccaattagacaatactctttcaagcactcgttttcagttatccccacctgcccagttcccttattaggctgagacactttaactaaattatctgcttccctgactgttcctggactacagctatatctcattgccgcccttcttcccaatccaaagcctcctttgtgtcctcctcttgtatccccccaccttaacccacgagtataagatacctctactccctccttggcgaccgatcatgcaccccttaccatctcattaaaacctaatcacccttaccccactcaacgccaatatcccattccgcagcacgctttaaaaagattaaagcctgttatcactcgcctgctacagcatagccttttaaagcctataaactctccttacaattcccccattttacctgtcctaaaaccagacaagccttacaagttagttcaggatctgcaccttatcaaccaaattgttttgcctatccaccgcgtggtgccaaacccatatactctcctatcctcagtacctgcctctacaacccattattctgttctggatctcacacatgctttctttactattcctttgcacccttcatcccagcctctcttcgctttcacttggactgaccctgacacccattaggctcagcaaattacctgggctgtactgccgcaaggcttcacagacagcccccattacttcagtcaagcccaaatttcatcctcatctgttacctatctgggcataattctcataaaaacgcacgtgctctccctgccaatcgtgtcctagtgatctctcaaaccccagcaccttctacaaaacaactcctttccttcctaggcatggttagcgtggtcagaattcttacacaagagccaggactgcaccctgtagcctttctgtccaaacaacttgaccttactgttttagcctagccctcatgtctgcgtgcaggggctgccgctgcattaatacttttagaggccctcaaaatcacaaactatgctcaactcactctctacagttctcataacttccaaaatctattttcttcctcatacctgacgcatatactttctgcttcccggctccttcagctgcactcactctttgttgagtcccacaattaccattgttcctggcccggacttcaatccagcctcccacattattccaggtaccacacctgacccccatgactgtatctctctgatccacctgacattcacctcatttccccaaatttccttctttcctgttcctcaccctgatcacgcttgatttattgatggtggttccaccaggcctaatcgccacacaccagcaaaggcaggttatgctatagtacaagccactagcctgcctcttagaacctctcatttcctttccatcgtggaaatctatcctcaaggaaataacttctcagtgttccatctgctattctactactcctcagggattattcaggcccccctcccttccctacacatcaagctcgaggatttgccccactcaggactggcaaattagctttactcaacatgccctgagtcagataactaaaatacctcttagtctagataaatactttcactggataggtagaggcctttcctacagggtctgagaaaccaccgcagtcatttcttccctcctgtcagacataattcctcagtttagccttcccacctctatacagtctgataacagatgagcctttattagtcaaatcagccaagcagtttttcaggctcttagtattcagtgaaacctttatatccctacggtcctccgtcttcaagaatattagaatggactaaaggtcttttaaaaacacacctcaccaagctcagtcaccaacttaaaaaggactggacaatacttttaccactttcccttctcagaattcaggcctgtcctgggaatgctacagggtacagcccatttaagctcctgtatagacgctcctttttattaggccccagtctcattcgacaccagaccaacttagactgtgccccaaaaaatacttgtcatccctactatcttctgtctaatcatactcctattcaccattctcaactactcatacatgccctgctcttgtttacacggccggtttacactgtttttccaagccatcacagctgatatctcttggtgctatccccaaactgccactcttaactcttgaagtaaataaataatctttgctggcaggactatgctgaatctccttaggcactctctaatcagatatcctgagtcatcccaattcttagaccttttatacctgtttttctccttctgttattccatttagtttttcaattcatacaaaaccgtatccaggccatcatcaatcattctatacgacaaacgtttcttctaacatccccacaatatcacccctcaccacaagacctcccttcagcttaatctctcccactctaggttcccacgccgcccctaatcccgcttgaagcagccctgagaaacatcgcccgttctctctccataccaccccccaaaaatgttcgccgccccaacacttcaacactattttgttttatttttcttattaatataagaaggcaggaatgtcaggcctctgagcccaagccaaaccatcgcatcccctgtgacctgcacgtatacgcccagatggcctgaagtaactaaagaatcacaaaagaagtgaatatgccctgccccaccttaactgatgacattccaccacaaaagaagtgtaaatggccggtccttgccttaactgatgacattaccttgtgaaagtccttttcctggctcatcctggctcaagaagctcccccactgagcaccttgcgacccccactcctacccaccagagaacaaaccccctttgactgtaattttcctttacctacccaaatcctataaaacggccccacccttatctccctttgctgactctcttttcggactcagcccgcctgcacccatgtgaaataaacagccatgttgctcatacaaagcctgtttggtggtctcttcacacggacgcgcatgaaa

SEQ ID NO: 9 - DNA, 7812 bp, Homo sapiens
gagagacaggactagctggctttcataggccgactaagaatccttaagcctagctgggaaggtgaccgcatccacttttaaacacggcacttgcaacttagctcacatctaaccagttagacagctcactaaaatgctaattaggcaaaaacaggaggtaaagaaatagccaatcatctattgcctgagagcacagcatgagggacaaggatcaggatataaacccaggcattcaagcctgcaacggcaaccccctttgggtctcctccctttgtatgggagctctgttttcactctatttcactctattaaatcttgcaactgcactcttctggtccatgtttgttacagctcgagctgagctttcactcaccgtccaccactgctgtttgctgccgtcgcagacctgccgctgactcccatccctccggatccggcagggtgtccactgtgcttctgatccagcgaggcgcccattgctgctcctgattgggctaaaggcttgccgttgttcctgcacggctaagtgcccgggttcgtcctaatcaagctaaacagtagtcactgggttccacggttctcttccgtgacccacggcttctgacagagctataacactcaccacatggcccaagattccattccttggaatctgtgaggccaagaaccccaggttagagaacctgaggcttgccaccatcttagaagcggcttgccaccatcttggaagtggctcgccaccattttggcaaccaggaagggacctccaaagcggtgagtaatactggaccactttcacttgctcttctgtcctatccttccttagaattgaaggaaaataccgggcacttgtcagccagttaaaaatgattagcgtggccgccagagttaagacccaggtgtgaggctatctggggaagggctttctaacaacccccaacccttctgggttggggacattggacaatctggaggtagcttccactttcaattttcttggggaagtcgagggccaactagaggcagaaagctgtagtcccgagctcccggcggtagccggttgagatcatggtgcagccagaagtctctttaacagtctcccatgcatgtgcctcttacctttccttctgacccatacctcctgggtcccaaccacgactttcttgaaagtgtagccccaatattctccttacctctgaatctacgtcctctgatccctgcctcctaggtactgatggttcagacttttaattcctctagcaagttgtatctccaaagggatctaaggaagctctactctgcgtccttaagcacctaggctataaccgagggagtcttatccctggtgtcccttctgatttaggtatacagctctcaacatgggcagttacgtgggacccgttccacaccatccttgccagggccccaagtttgtaatggctaagagagagagagagagacggagagagagagagacagagagacagaaagagagacggagagagagagagataaagaaggagtcaaagagaaaaagaaagaaaaagatagaaatagtaaaaaaaaaaaaaaaaaaagtaaagaaaaaaaaaaaaccagtgtgccctattcctttaaaagccagggtaaatttaaaatctataattggtaattgaaggtcttctgcgtgaccctataacactgcaatactaccttgttgtcagtgtaaacaagggcgtagcctgaaatcactgagaccactgacaacccgtagctttcctatcaaaaatccttaacccagtaacccgcagatgcattcgatctgtagcagcaactgctttgctaaaagtagaaaaataacttttagaggaaacctcattgtgagaacacctcgccagttttctaagtcgaaaaagcaaaaaggatagcttactaactcaaaaatcttaaagtatggggctatcctgttagaaaagggtaatgtaactccaaccactgataattcccttaacccagcagatttcctaacagaggatttaaatcttaattaccacacaaaggtccgaccagacctaggaggaactcccttcaggacaggacgatagatggttcctcccaggtgactgaggaaaaaaaccacaatgggtattcagtaattgatacagagactcttgtggaagcagttagaaaaattgcctaaaaatttgtctccttaaacatgccagctgtttccactcagacaagccttaaaatacttacagaatcaaaaagacttctcaatccttactcaaaaggttacctatgccctctttgaaataaattttcataagaactgcttttataggaatgcatcttaatggggcagctaggtggttatgaaatgctcaggaacccagccaagctctaggactcacccctggtcgcaaaggcaatgttgggcatgctggtaaaggaccactagaatccagcagcccggacccctttctttgtggtcaagggaggcgggaaaacaggtgcaggactgctacatcggtgagcataactaatccgataagcagaggtccatgggtggttactcaccctggaaaagaataagcattaggcccttagaggacgctctagggctaatgctcatcggaaaatgactaggggtgctggcatccctatgttcttttttcagatgggaaacgttccccccaccccaaggcaaaaacgcccctaagatgtattctggagaattaggaccaatttgaccctcagacgctaagaaagaaatgacttatattcttctgcagtaccgcctggccacgataccctcttcaagggggagaaacctggcctcctgagagaagtataaattataacaacatcttactgctagatctcttctgtagaaaggagggcaaatgtagtgaagtgccataggtgcaaactttattttcattaagagacaactcgcaattatgtaaaaagtgtggtttatgccctacaggaagccctcagagtctacctgcctatcccagcatgcccccgactccttccccaaccaataaggaccccctgttacccaagtggtccaaaggagatagacaaagggatgaacaatgaaccaaacagtgccaatattccctgattatgtcccctccaagcagtggtaggaagagaattcagcccagccagagtgcatgtacctttttctctctcagacttaaagcaaattaaaatagacctaggtaaattctcagataatcctgatggctatattgatgttttacaagggttaggacaatcctttgatctgcaatggagagatataatgttactgctaaatcagacactaaccccaaatgagagaagtgccaccataactgcagcccgagagtttgacgatctctggtatctcagtcaggtcaatgataggatgacaacagaggaaagagaacgattccccacaggccagcaggcagttcccagtgtagatcctcactgggacacagaatcagaacatggtactgcagacattagctaacttacgtgctagaaggactaaggaaaactaggaagaagcctatgaattattcaatgatgtccactataacacagggaaaggaagaaaatcctactgcctttctggagacactaaggggggcattgaggaagcatacctctctgtcacctgactctattgaaggccaattaatcttaaaggataagtttatcactcagtcagcttcagacatcagaaaaaaagcttcaaaagtccaccttaggcctggagcaaaacttagaaaccctattgatcttggcaacctctgttttttataatagagatcaggaggagtaggcggaacgggacaaatgggataaaaaaaaagaccaccgctttagtcatggtcctcaggcaagtggactttggaggctctggaaaagggaaaagctgggcaaatcgaatgcctaatagggcttgcttccagtgcggtgtacaaggacactttaaaaaaagattgtccaagtagaagtaagctcccccctcgtccatgccccttctgtcaaaggaatcactggaaggtccactgccccaggggatgaagctcctctgagtcagaagccactaactagatgattcagcagcaggactgagggtgcctggggcaagtgccagcccatgctgtcaccctcacagggccccagatatgcttgaccattgagggccaggaggttaactgtctcctggacactggcacggccttctcagtcttactctcctgtcccagacaactgtcctccagatctgtcactatctgaggagtcctaggacagccagtcactagatacttctcccagccactaagctgtgactgtggagctttactcttttcacatgcttttctaattatgcctgaaagccccactcccttattaaggagagacattctagcaaaagcaagggccattatacacctgaacataggagaaggaacacccatttgttgtcccctgcttgaggaaggaattaatcctgaagtctaggcaacggagggacaatatagatgagcaaagaatgcccatcctgttcaagttaaactaaaggattccacctcctttccctaccaaaggcagtaccccttagacccaaggcccaacaaggactccaaaagattgttaaggacctaaaagcccaaggcctagtaaaagcatgcagtagcacctgcaatactccaattttatgagtacagaaacccaacggacagtggaggttagtgcaagatctcagggttatcaatgaggccgttgtccctctatacccagctgtacctcacccttatactctgctttcccaaatactagaggaagcagagtggtttacagttctggaccttaaagatgcctttttctgcatccctgtacatcctaactctcaattcttgtttgcctttgaggattcttcgaacccaacgtctcaattcacctggactgttttaccccaaaagttcaaggatagcccccatctatttggccaggcattagcccatgacttgagccaattctcacacctggacactcttcctttggtacagggatgatttaattttagccacccgttcagaaaccttgtgccatcaagccacccaagcactctttaatttcctcgctacctgtggctacaaggtttccaaatgaaaggctcagctctgctcacagcaggttaaatatttagggctaaaattatccaaaggcaccagggccctcagtgaggaacgtatccagcctatactggcttatcctcatcccaaaaccctaaagcaactaagagggttccttggcataacagttttctgccgaatatggattcctaagtactgcgaaatagccagaccattatatacactaattaaggaaactcagaaagccaatacccatttagtaagatggacacctgaagcagaagcggctttccaggccctaaagaaggccctaacccaagccccagtgttgagcttgccaaccgggcaagacttttctttatatgtcacagaaaaaacaggaatagctctaggagtccttacacgggtccaaaggatgagcttgcaacctgtggcatagctaagtaaggaaatagatgtagtggcaaagggttggcctcattgtttacgggtagtggcagcagtagcagtcttagtgtctgaagcagttaaaataatacagggaagggatcttactgtgtgaacatctcatgatgtgaatggcatactcactgctaaaggagactcgtggctgtcagacaaccatttacttaaatatcaggctctattacttaaagggccagtgctgcgactgcgcacttgtgcaactcttaacccagccacatttctttcagacaatgaagaaaagttagaacataactgtcaacaagtaattgctcaaacctatgccactagaggggaccttttagtttcccttgactgatcctgacctcaacttgtatactgattgaagtcctttttctacaaggaaacttctaaaagtgagctatgcagtggtcagtgataatggaatacttaaaagtaatcccctcactccaagaactagtgctcagctggcagaactaatagccctcacttgggcactagaattaggagaaagaaaaaaggtaaatatatatacagcctctaagcatgcttacctactcctccatgcccatgcaacaatgtagagagaaaaggaattcctaacttccgaaggaacacgtatcaaacatcaggaagccattaggagattattattggctgtacagaaacctaaagaggtaacaatcttacactgccaaggtcatcagaaaggaaaagaaaggaaaatagaaaggaaccaccaagcggatactcaagtcaaaagagccgcaaggcaggaccctccattagaaatgcttatagaaggacccctagtatagggtaatcccctccaggaaaccaagccccagcattcagcaggaaaaatagaatagggaacctcacaaggacatactttcctcccctccagatggctagccactgaagaaggagaaatacttttgtctgcagctaaccaatagaaattacttatcaccaaaccttccacttaggcattgatagcacccatcagatggccaaattattatttactggaccaggccttttcaaaactatcaagcagatagtcagggcctgtgaagtatgccaaagaaataatcccctgcactgcaggccatacatttcaatccctgtatctttaacctccttgttaagtttgtctcttccagaatcaaaactgtaaaactacaaatagttcttcaaatggggccccagatgcagtccatgactaagatccaccgcgggcccctagactggcctgctagcccatgctccgatattaatgacatcgaaggcacccctcccaaggaaatcacaactgcccaacccctactatgccccaattcagcaggaagcagttagagctgtcattggccaacctccccaacagcacttgggttttcctgttgagggcgggtactgagagacaggactagctggatttcctaggctgactaagaatccctaagcctagctgggaaggtgaccgcatccacttttaaacatggggctcgcaacttagctcacacccaaccagtcagagagctcactaaaatgctaattaggcaaaaacaggaggtaaagaaatagccaatcatctattgcctgagagcacagcaggagggacaaggatcaggatgtaaacccaggcattcaagctggcaacggcaaccccctttgggtcccctgcctttgtatgggagctctgttttcactctatttcactctactaaatcttgcaactgcattcttctggtccatgtttgttacggctcgagctgagctttcgctcgctttccaccactgctgtttgccgctgtcgcagacctgccactgactcccatccctccggatccggcaggctgtccgctgtgctcctgaaccagcgaggcacccattgccaatcctgattgggctaaaggcttgccgttgttcctgcacggctaagtgcccaggttcatcctaattgagctgaacactagtcactgggttccacggttctcttccatgacccatggcttctaatagagctataacactcaccgcacggcccaagattccattccttggaatctgtgaggccaagaaccccaggtcagagaacacgaggctagccaccatcttggaagtggcctaccaccatcttggaagtggctcgccaccatctgaggagctctgtgagcaaggacccccggtaagagttagg

SEQ ID NO: 10 - DNA, 3769 bp, Homo sapiens
aattgaagatccacagaagaagtaaaaacagccttaactgatgacattccaccattgtgatttgttcctgccccaccctaactgatcaatgtactttgtaatctcccccacccttaagaaggttctttgtaattctccccacccttgagaatgtactttgtgagatccacccctgcccaccagagaacaaccccctttgactgtaattttccattaccttcccaaatcctataaaacagccccacccctatctcccttcacttgactctcttttcagactcagcccacctgcacccaggtgaaataaacagctttattgctcacacgaagcctgtttggtggtctcttcacacggatgcgcatgaaatttggtgccgtgacttggatcgggggacctcccttaggagatcaatcccccgtcctcctgctctttgctccgtgagaaagatccacctacgacctcaggtcctcagaccgaccagcccaagaaacatctcaccaatttcaaatctggtaagcggcctctttttactctcttctccattcctcctccttctcccttagcttctccaacctccctcactatccctcaacctctttctcctttcaatcttggcgccacacttcaatctctcccttctcttaatttcaattcctttcattttctggaagagacaaaagagacatgttttatccgtgaacccaaaactccggcgctggtcacggactgggaaggcagccttcccttggtgtttaatcattgcagggacgcctctctgattatacactcacgtttcaagggtgtcagaccacgcagggacgcctgccttggtccttcacccttagcggcaagtcccgctttcctggggcaggggcaagtacccctcaaccccttctccttcaccctcagcggcaagtcccgcttttctggggcaggggcaagtacccctcaaccccttccccttcacacttagtggcaagtcccgctttcctggggcaggggcaagtacccctcaacgccttctccttcacccttagtggcaagtcccgcttttctagggggcaagaacccccaaaccccttccatctgtgtctctacgctctcttctgtgggtttgcttccttcactatgggcaaccttccaccctccattcctccttcttctcccttagcctgtgtgctcaaaaagttaaaacctcttcaactcacacctgacctaaaacctaaatgccttattttcttctgcaacaccgcaaccgcttggccccaatacaaacttgacaatgtctctaaatggccggaaaatggcactttcgatttctccatcctacaagacctaaataatttttgtcgaaaaatgggcaaatggtctgaggtgccttacgtccaggcatttttcacacttcgttccctccctagtctctgttcccaatgcgattcctcccagatcctcctcctttccctcccgcctgtcccctcggtcccaaccccaagcgtcgctgagtcttcccagtcttccttttctacagacccatctgacctttcccctcctccccaagctgcttgtcgccagaccgagctaagtcccaatacttcctcagcctccactcctccaccctataatccttctatcacctcccctcctcacacctggtccggcttacagtttagttccgcgactagcgcttccccacctgcccaacaatttcctcttagagaagtggctggagctgaaggcatagtcaaggtacatgtacttttttctctatcagacctctctcagatcagtcaatgtttaggctctttctcatcagaccccactaaatatatacaggaattccaatatctaactctgtcctacaacttaacctggagtgacttaaatgtcatcctgacttctactctctccccagatgaacgggaaagttttttctctagcccaatctcgtgctgataaccgccggcttcatgagccagacctccaggaaggcattagagcagttccccgagaggatccccaatggaactatcaggcagattccccaggtacagctaggcgagattacatggtttcctgcctagttgaagggcttaaaaaagcagcttacaaagctgttaattatgacaagcttaaagaaactacccgaggtaaagacgaaaacccagcccaggtcatggcccacttagcagcaaccattagatgctatactgccctagacccagaggggccagaaggccgccttattcttaatatgcatttttatcacccaatccactcctgacattaggaaaaaacttcaaaaattagaatctggccttcaaacccagcaggaattaatcaaccttgccttcaaggtgtacaataatagagaggaagcagccagacggcaacgcatttcggagttacaattacttgcctctgctgtgagacaaaacccagccacacctcctgcatacaggaacttcaaaatgcctaagacgcagcaatcagacactcctacaagacttcatcaggatcttgcttcaagtgccagaaatctggccactgggccaaggaatgcccacagcccaggattcctcccaagccatgtcccatctgtgcaggcacccactggaaatcagactgcccagctcgcccgacagccactcctggagcccctaaagctctagcccaaggctctctgactccttcccagatctattcggcttagcgactgaagattgacgctgcccgatcgcctcggaagtcccctggaccatcacagaagccgagcttcgggtaactctcacagtggagggtaagtccatcccctgtttaatcgatacgggggctacccactccacgttgccttcttttcaagggcctgtttcccttgcccccataactgttgtgggtattgacggccaagcttcaaaacccctgaaaactcccccactctggtgccaacttggacaacactcttttatgcactcttttttagttatccccacctgcccacttcccttattaggccgaaatattttaaccaaattatctgcttccctgactattcctggagtacagctacatctcattgctgcccttcttcccaatccaaagcctcctttgtgtcctctaacatccccacaatatcaccccttaccacaagacctcccttcagcttaatctctcccactctaggttcccacgccgcccctaatcccacttgaagcagccctgagaaacatcgcccattctctctccataccaccccccaaaaattttcgccgctccaacacttcaacactattttgttttatttgtcttattaatatcagaaggcaggaatgtcaggcctctgagcccaggccaggccatcgcatcccctgtgacttgcacgtatacatccagatggcctgaagtaactgaagatccacaaaagaagtaaaaacagccttaactgatgacattccaccattgtgatttgttcctgccccaccctaactgatcaatgtactttgtaatctcccccacccttaagaaggttctttgtaattctccccacccttgagaatgtactttgtgagatccacccctgcccaccagagaacaaccccctttgattgtaattttttattaccttcccaaatcctataaaacagccccacccctatcttccttcactgactctcttttcggactcagcccaccggcacccaggtgaaataaacagctttattgctcacacaaagcctgtttggtggtctcttcacacggacgcgtatgaaa

SEQ ID NO: 11 - DNA, 3547 bp, Homo sapiens
gtcaggcctctgagcccaagccaagccatcgcatcccctgtgacttgcatgtatacgcccagatggcctgaagtaactgaagaatcacaaaagaagtgaatatgccttgccccaccttaactgatgacattccaccacaaaagaagtgtaaatggccggtccttgccttaactgatgacactaccttgtgaaagtccttttcctggctcatcctggctcaaaaagcacccccactgagcaccttgcgatccccactcctacccgccagagaacaaaccccctttgactgtaattttcctttacctacccaaatcctataaaacggccccacccttatctccgtttgctgactcttttcggactcagcctgcctgcacccaggtgaaataaacagccatgttgctcacacaaagcctgtttggtggtctcttcacacggacgcgcatgaagtttggtgccatgactcggatcgggggacctcccttgggagatcaatcccctgtcctcctgctctttgctccgtgagaaacatccacctacgacctcaggtcctcagaccgaccggcccaagaaacatctcaccaatttcgaatccggtaagtggcctctttttactctcttctccaatctccctcactatccctcaacctctttctcctttcaatcttggcgccacacttcaatctctcccttctcttaatttcaattcctttcattttctggtagagacaaaagagacatgttttatccatgaacccaaaactccagcgccggtcacgggctgggaaggcagccttccccttggtgtttaatcattgcagggacacctctctgattatacactcacgtttcaagggtgtcagaccacgcagggacgcctgccttggtccttcacccttagcggcaagtcccgctttcctggggcaggggcaagtatccctcaaccccttctccttcacccttagtggcaagtcccgctttcctggagcaggggcaagtacccctcaatcccttctccttcacccttagtggcaagtcccgctttcctagggggcaagaagcccccagttgcttatttccacaccccaacctcttatctctgtgccccaatcccttatttccgcaccctgacctcttatctctgtgcccccatcccttatttccgtgccccaaccccttctctgcttttctggagggcaagaaccccccaacccttctccgtgtctcttttctctgggcttgcctccttcactatgggtaagcttccaccctccattcctccttctcctcccttagcctgtgttctcaaaaacttaaaacctcttcaactcacacctgacctaaaacctaaatgacttattttcttctgcaatgccgtttgaccccaatacaaactcgacagtagttccaaatagccagaaaatggcactttgaatttttccatcctgcaaaatctaaataattcttgtcgtaaaataggcaaacggtctgaggtgcctgacgtccaggcattcttttacacatcagtcccttcctagtctctgtgaccagtgcaactcgtcccaaatcttccttctttccctcccgcctgtcccctcagtaccaaccccaagcgtcgctgagtctttctaatcttccttttctacagacccatctgacctctcccttcctccccaggctgctcctggccaggccgagctaggtcccaattcttcctcagcctctgctcctccaccctataatctttttatcacctcccctcctcacacctggtcgggcttacagtttcgttcggtgactagccctcccccacctgcccagcaatttactcttaaaaaggtggctggagctaaaggcatagtcaaggttaatgctcctttttctttaccccaaatcagatagcgtttaggctctttttcatcaaatataaaaatccagcccagttcatggcttgtttggcagcaaccctgagacgctttacagccctagaccctaaaaggtcaaaaggccgtcttatgctcaatatacattttattacccaatctgctcccgatattaaataaaactccaaaaattaaattctggccctcaaaccccacaacaggatttaattaacctcaccttcaaggtgtaccataatagaaaaaagttgcaattccttgcctccactgtgagacaaaccccagccacgtctccagcacacaagaacttccaaacgcctgaaccgcagcggccaggcgttcctccagaacctcctcccacaggagcttgctacacgtgccagaaatctggccactgggccaaggaatgcccgcagcctgggattcctcctaagccgcgtcccatctgtgtgggaccccactgaaaatcggactgttcaactcacctggcagccactcccagagcccctggaactctggcccaagcctctctgactgactccttcccagatcttctcggcttagcggctgaagactgacactgccggatcacctcggaagccccctagacagtcactgacgccgagcttcaggtaactctcacagtggaaggtaagcccgtccccttcttaatcaatacggaggctactcactccacattaccctcttttcaagggcctgtttcccttgcctccataactgttgtgggtattgacggccaggcaaacctcttaaaactccccaactctggtgccaacttagacaatactcttttaagcactcctttttagtcatccccacctgcccagttcccttattaggccgagacactttaactaaattatctgcttccctgactattcctggactacagctatatctcattgccgcccttcttcccaattcaaagcctcctttgcgtcctcctcttctatccccccaccttaacccacaagtataagatacctctactccctccttggcgaccgatcatgcaccccttaccatctcattaaaacctaatcacccttaccccactcaacgccaatatcccatcccgcagcacgctttaaaaagattaaagcctgttatcactcgcctgctacagcatggccttttaaagcctataaactctccttacaattcccccattttacctgtcctaaaaccagacaagccttacaagttagttcaggatctgcaccttatcaaccaaattgttttgcctatccaccccgtggtgccaaacccgtatactctcctgtcctcaatacctgcctctacaacccattattctgttctagatctcaaacatgctttctttactattcctttgcacccttaatcccagcctctctttgctttcacttggactgaccctgacacccatcaagctcagcaaattacctaggctgtactgccgcaaagcttctcagacagcccccattacttcaatcaagcccaaatttcttcctcatctgttacctatctcggcataattctcataaaaacacacgtgctctccctgccaatcgcgtccgactgatctctcaaacccaagcaccttctataaaacaacaactcctttccttcctaggcgtggttag

SEQ ID NO: 12 - DNA, 7190 bp, Homo sapiens
gccaggcctctgagcccaagctaagccatcatatcccctgtgacctgcacgtatacatccagatggcctgaagtaactgaagaatcacaaaagaactgaaaatgccctgttcctgccttaactgatgacattaccttgtgaaattccttctcctggctcatcctggctcaaaagctcccccactgagcaccttatgacccccgcccctgcccgccagcgaacaacaccctttgactgtaattatccactacccacccaaatcttataaagctgccccacccttatctcccttcgctgactcttttcggactcagcccgcctgcacccaggttaaataaacagcctcattgctcacacaaagcctgtttggtggtctcttcacacggatgcgtgtgacatttggtgccatgactcggatcagggatccttgggagatcaatcccctgtcctcctgctctttgcacctacgacctctggtcctcagaccaaccagcccaaggaacatctcaccaattttaaattggataagcggcctctttttacgcttttctccaacctctctcactatccctcaacctctttctcctttgaatcttggtgccatctttcagtctctcccttctcttaatttcagtgcctttccttttctggtagagacaggagacgcgttttatccgtgaacccaaaactccatcgctagttacggactcgggaaaacagtcttcccttggtgtttaatcacgcagggatgcctgcttgattactcacccacgtttcagaggtgtctgatcacacagggacgcctgccttggtccttcacccttagcagcaagcactgcttttcttgggggcaagcacccctcaccccttctctccgtgtctctaccccttttccactgtcctggggggcaagcaccccccatcccttctctctgtgtgtctaccccttttccactgtcctggggggcaagcatccccccaccttctctccgtgtctctaccctctcttttctctggacttgcctccttcactataggcaaacttccaccctccattcctccttcttctcctttagcctgtgttctcaagaactcaaaacctcttcaactcacacctgacctaaaacctaaatgccttattttcttctgcaatgctgcttgaccccaatgcaaacttgacaatggttccaaatagccagaaaacggcactttcgatttctccatcctacaaggtctaggtaattcttgtcatgaaatgggcaaatggtctgaggtgcctgacgtccaggcattcttttacacatcagtccctccctagtctctgttcccaatgcaattagtcccaaatcttgcttctttccctcccacctgtcccctcagtcccaaccccaagcattgctgagtctttccaatcttccttttctacagacccatctgacctctcctttcctccccaggttgctcctcaccaggcctagccaggtcccaattcttcctcagcctccgctcccctaccctataatccttttatcacctcctctcctcacacccgacgcggcttacagtttcgttctgcgactagccctccccgacctgcccagcaatttcttcttaaaaggtggctggagccaaaggcatggtcaaggtttttctttatccgacctctcccaaatcagttagcgtttaggctctttttcatcaaatagaaaaacccagcccagttcttggctcgtttggcagcaacctgagacgctttacagccctagaccctgaaaggtcagaaagaaggccatcttattcttaatacgcattttattacccagtccgctcctgacattaaataaagctccaaaaattagattccagccctcaaaccccacaacaagacttaattaacctcgccttcaaggtgtacaataatagagcagaggcagccagacagcaacgcatttctgagttacaattacttgcctctgccatgagacaaaacccagccgcacctccagcatacaagaacttcaaaatgcctaagccgcgcacacctaagccacagcggccaggcgttcctacaggacttcctccaccaggatcttgcttcaagtgccagaaatctggccactgggccaaggaatgcccgcagcccaggattcctcctaagccgtgtcccatgtgtatgggaccccactggaaatcagactgtccaagtcacccagcagccaaccccagagtccctggaactccggcccaaggctctctgactgactccttcccagatcttcttgacttagcggctgacgaccgacgctgcccaattgcctcagaagcttcctggaccatcacagatgctttgggtaactcttatagagtgaagggtaagtccatccccttcttaatcaatactgaggctacccactccacattaccttcttttcaagggcctgtttgttatgcctccataactgttgtgggtgttgacggccaggcttctagacctcttaaaactccccaactctgatgctagcttggacaatattcttttatatactccttctagttatccccacctgcccagctcccttgttaggtcaagacattttaactaaattatctgcttccctgactgttcctgggctacagccacatctcattgctgcctttttccccagttcaaagcctcctttgcattctccccttgtatctccccaccttaatccacaagggtaggacacctctactccctccttggcgattgatcatgcaccccttaccatcccattaaaacctaatcacccataccccgctaaacgccaatatcccatcacacagcacgctttagaagcctgttattactcgcctgttacagcatggccttttaaaacctataaactctccttacaattcccccattttacctgtcctaaaaccagacaagtattacaggttagttcaggatctgcgccttatcaaccaaattgttttgcctatccaccccgtggtgccaaacccatatactctcctatcctcaatacctccctccacaacccattattctattctagataaacctagctgaccccataaatcctaaatcctttccccactcccctttccattccttaaaaaacagctctaaaagctgctcccacactagctctccctaactcatcccaacctttttcattatacacagccaaagtgcaggactctgtggtcggaattcttacacaagagccaggaccgcgccctgtagtctttctgtccaaacaatttgaccttactcttttagcctagccttcatgtctgtgtgtggcagctgccgctgctttaatattttcagaggccctcaaaatcacaaactatgctcaactcactctctacagttctcataacttccaaaatctattttcttcctcacacctgacacatatactttctgccctctggctccttcagctatactcgctctttgttgagtctcccacaattaccattgttactggcccggacttcaatccggcctcccacattattcctgataccacacctgacattcactccaattccccatatttccttctttcctgttcctcaccctgaacacacttggtttattgatagcagttccaccaggcctaactgccactcaccagcaaaggcaggctatgctatagtatcttccacacctatcagtgaggctaccactctgcccccgtccactacctctcaactagccaaactcattgccttcactcgagcccttgctcttgcaaaaggactacgcatcgatatttatattgactttaaatatgccttccatatcctgcaccaccatgctgttatatgggcagaaagaaatttcctcactatgcaagggtcctccatcattaatgcctctttaataaaaactcttctcaaagccgctttacttccaaaggaggctagagtcaccgggcgcggtggctcacgcctgtaattccagcactttgggaggccgaggtgggtggatcacaaggtcaggagatcgagaccatcctggctaacacggtgaaaccccgtctctactaaaaatacaaaaaattagccaggcatggtggcgggtgcctgtagtcccagctactccagaggctgaggcaggagaatggcgtgaacctgggaggcggagcttgcggtgagccgagatggcaccactgcactccagcctgggcgagagtgtgagactctgtctcaaaaaaaaaaaaaaagaaagaaagaaaggaaggaagctagagtcattcactgcaagcagccatcaaaaggcatcagacctctcattgctcagggcaatgcatatgctgataaggtagctaaaaaagcacctagcattccaacttctatccctcatggcagtttttctccttctcatctggccactcccacctactcccccactcaaacttgcacctatcaatctcttcccacacaaggcaaatggttcttggaccaaggaaaatatctccttccagcctcacaggcccattctattctgtcatcatttcatagcctcttccatgtaggttacaagccgctggtctgcctcttagaacctctcatttcctttccatcgtaaaaatctatcctcaaaaaaatctcagtgttccatctgctatctactactcctcagggattattcaggccccctcccttccctacacatcaagctcggggatttgccccctgcccaggactggcaaattgactttactcacatgccccgggtcagaaaactaaaatacctcttggtctgggtaaacactttcactgggtgggtagaagcctttcccacagggtctgagaaggccaccgcggtcatttcttctcttctgtcagacataattcctcggtttggccttcccacctctatacagtctgataatggaccggcctttattagtcaaatcacccaagcagtttctcaggctcttgttatttagtggctcctggttttacctcaaatccccacccttaagtctctctttaagtggatagaagatcttcagtgacaaagtacactccaatactttcaccctgatgaagtcctattctttacttttatactcactcttactcttgttcccgttcttatgccacgctctacctctccccagctatctccaccacactatcaatctcagtcactctctcctagccgtttctaatccttctttaacaattgctagctttgcatttctctttcctccaaaatcgccgaggcctcgacttactcactgctaaaaataaaataaaaaaaataaaaaaaggggggggtactctgtatatttttaaatgaacagtgctgtttttacctaaatcaatctggcctggtatatgacaacataaaaaaaaaaaaaaagctcaaagatagagcctaaaaacttgccaaccaagcaagtaattaggctgaacccccttaggcactctctaattggatgtcctgggccctcccaattcttagtcctttaatctctgtttttctccttctcttatttggaccttgtgtcttctgtttagtctctcaactcatacaaaactgcatccaggccatcaccaaacattctatgggacaaatactccttttaacaaccccacaatatcgccccttaccacaaaatcttccttcagcttaatctctcccactctaggttcccatgtcgcccctaatcccgctcgaagcagccctgagaaacatcgcccattatctctccatatcaccccccaaaattttcgccgccccaacactttaccactatttcattttatttttcttactaatataagaagacaagaatgtcaggcctctgagcccaagctaagccatcatatcccctgtgacctgcacatatatatacatccaggtggcctgaagtgaagaaccacaaaagaagtgaaaatggcctattccttgtggggaaaagaaagacagatcagattgttactgtgtctgtgtagaaagaagtagacataggagactccattttgttctgtactaaaaaaaattcttctgccttggtatgctgttaatctatgaccttacccccaacgccgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcaggttcctctgcctaggaaagccaggtattgtccaaggtttctccccatgggatagtctgaaatatggcctcatgggaagggaaagacctgaccgtcccccagcccgacacccagtaaagggtctgtgctgaggagcattagtataagaggaaggaatgcctctttgcagttgagacaagaggaaggcatctgtctcctgctcgtcactgggcaatggaatgtctcggtataaaacctgattgtatgttccatctactgagataggggaaaaccgccttagggctggaggtgggacatgcgggcagcaacactgctctttaaggtattgagatgtttatgtgtgtgcatatctaaagcacagcacttaatcctttaccttgtctatgaggtagagacctttgttcacgtgtttatctgctgaccttctctccactattatcctatgaccctgccacatccccctctccgagaaacacccaagaatgatcaataaatactaagggaactcagaggctggcgggatcctctatatgctgaacgctggtcccctgggcccccttatttctttctctatactttgtctctgtgtctttttcttttccaagtctctcgttccacctaacaagaaagacccacaggtgtggaggggcaacccaccccttcaattcctgccttaactgatgacattactttgggaaattccttttcctggctcataagctccccaactgagcaccttgtgacccttgcccctgcctgccagagaacaaccctctttgactgtaattttccactacccacccaaatcctataaaatggccccacccttatctcccttcgctgactcttttttcagactcagcccgcctgcacccaggtgaaataaacagccttgttgctcacacaaagcctgtttggtggtctcttcacacggacgtgagtgaaa

SEQ ID NO: 13 - DNA, 5347 bp, Homo sapiens
gactcggatcgggggacctcccttgggagatcaatcccctgtcctcctgttctttgctccgtgagaaagatccacctacgacctcaggtcctcagaccgaccagcccaaggaacatctcaccaattttaaatcgggtaagtggcctcttcttactcttctccaacctctctcactgtccctcaaccactttctcctttccactcttcaatctctcccttctcttaatttcaattcctttcattttctgggagagacaaaggagacacgttttatcagtggacccaaaactctggcactggtcacggactgggaaggcagccttcccttggtgtttaatcattgcagggacgcctctgattatacacccacgtttcaagggtgtcagaccacgcagggacgcctgccttggtccttcacccttagcagcaagtcccgcttttctggggaaggggcaagtacctcaaccccttctctccttgtctctaccccttctctgcttttccagggacagggcaagtaccccaaccccttctctccttgtctctaccccttctctgtttttctgggagaggggcaagtacccctcaaccccttctccttcactcttagcggcaagtcccgcttttctagaggaggggcaagtaccccaacctcatacctctgtgccccaatcccttatttctgcaccccaacctcttatctgtgtgccccaatcccttatttctgtgccccaaccccttatttctgcaccccatcccttatttccgtgccccgacctcttatctctgcgccccaacccattttcccacttttctggaaggtaagaacccccgaaccccttctctccatttctctactctctctttatgggcaaccttctaccctccattcctcctcctactcccttggcctgtgttctcaaaaacttaaaacctctttaacacctgacctaaaacctaaatgccttattttcttctgcaatgccgcttgaccccaatacaaacttgacagtagttccaaatagccagaaaatggcactttgaatttttccatcctgcaatatctaaataattcttgtcttaaaataggcaaacagtctgaggtgcctgacgtccaggcattcttttacacatcagtcccttcctagtctctgtgcccagtgcaactcgtcccaaatcttccttctttccctcccacctgtcccctcagttccaaccccaagcgtcactgagtctttctaatcttccttttctacagacccatctgacctctcccttcctccccaggctgctcctcgccaggccgagctaggtcccaattcttcctcagcctccgctcctccaccctataatcctttatcacctcccctcctcacacctggtccggcttagtttcgttccgtgactagccctccccctcccgcccagcaatttactcttaaaaaggtggctggagctaaaggcatagtcaaggttaatgctcctttttctttatcccaaatcagatagcgtttaggctctttttcatcaaatataaaaatccagcccagttcatggctcgtttggcagcaaccctgagacactttacagccctagaccctaaaaggtcaaaaggctgtcttattctcaaaatacattttattacccaatctgctcctgacattaaaactccaaaaattaaattccagccctcaaaccccacaacaggatttaattaacctcgccttcaaggtgtacaataatagaaaaaagttgcaattccttgcctccactgtgagacaaaccccagccacatctccagcgcacaagaacttccaaatgcctgaacggcagtggccaggcgttcctccagaacctcctcccacaggagcttgctacacatgccggaaatctggccactgggccaaggaatgcccgcagcccgggattcctcctaagccgcgtcccatctgtgtgggaccccactgaaaattggactgttcaactcacctggcagccactcccacagcccatggaactctggcccaaggctctttgactgactccttcccagatcttctcggcttagcagctgaagactgacactgcccgatctcctcggaagccccctagaccatcacggacaccgagcttcgggtaactctcacagtggaaggtaagcccgtccccttcttaatcaatacggaggctacccactgcacattacctttttttcaagggcctgtttcccttgcctccataactgttgtgggtattgatggccaggcttctaaacctcttaaaactccccaactctggtgccaacttagacaatactcttttaagcactcctttttagttatccccacctgcccagttcccttattaggctgagacactttaattatctgcttccctgactattcctggactacagctatatctcattgccgcccttcttcccaatccaaagcctcctttgcatcctcctcttgtatccccccaaccttaacccacaagtataagatacctctactccctcttaggcaaccgatcatgcaccccttaccatctcattaaaacctaatcacctttaccctactcaacgccaatattccatcccgcagcacactttaaaaagattaaagcctgttatcactcgcctgctacagcatggccttttaaagcctataaactctccttacaattcccccattttacctgtcctaaaaccagacaagccttacaagttagttcaggatctgcaccttatcaaccaaattgttttgcctatccacccggtggtgccaaacccatacactctcctatcctcaatacctgcctctacaacccattattctgttctagatctcaaacatgctttctttactattcctttgcaccctcaatcccagcctctcttcgctttcacttggactgaccctgacacccattaagctcagcaaattacctaggctgtactgccgcaaagcttcacagacagcccccattacttcaatcaagcccaaatttcttcctcatctgttacctatctcggcataattctcataaaaacacacgtgctcttcctgccaatcgtgtccgactgatctctcaaaccccagcaccttctacaaaacaacaacttctttccttcctaggcatggttagcacggtcagaattcttacacaagagccaggaccacaccctgtagcctttctgtccaaacaacttgaccttactgttttagcctagccctcacgtctgcatgcagcagctgccgctgctttaatacttttagaggccctcaaaatcacaaactatgctcaactcactctctacagttctcataacttccaaaatctattttcttcctcatacctgacgcatatactttctgctccccggctccttcagctgtagtcactctttaagtcccacaattaccattgttcctggcctggacttcaatctggcctcccatgttattcctgataccacacctgacccccatgactgtatctctctgatccacctgatattcaccccatttccccatatttccttctttcctgttcctcaccctgatcacgcttgatttattgatggcggttccaccaggcctaatcgccacacaccagcaaaggcaggttatgctatagtacaagccactagcccgcctcttagaacctctcatttcctttccatcgtggaaatctatcctcaaggaaataacttctcagtgttccatctgctattctactgctcctcagggattattcaggtcccctcccttccctacacatcaagctcgaggatttgccccacccaggactggcaaattagctttactcaacatgccctgagtcggataactaaaatacctcttagtctaggtagatactttcactggataggtagaggcctttcctacagggtctgagaaggccaccgcagtcatttcttccgttctgtcagacataattcctcagtttagccttcccacctcaatacagtctgataacagatgagcctttattagtcaaatcagccaagcagtttttcaggctcttagtattcagtgaaacctttatatcccttacggtcctccgtcttcaagaaaagtagaatggactaaaggtcttttaaaaacacacctcaccaagctcagccaccgaaaaggactggacaatacttttaccactttcccttctcagaattcaggcctgtcctcggaatgctacagggtacagcccatttaagctcctgtatagacgctcctttttattaggccccagtctcattccagacaccagaccaacttagactgtgccccccaaaaaacttgtcatccctactatcttctgtctagtcatactcctattcaccgttctcaactactcatacatgccctgctcttgtttacactgccggtttacactgtttttccaagccatcacagctgatatctcctggtgctatccccaaactgccactcctaactcttgaagtaaataaataatctttgctggcaggactatgctgaatctccttaggcactctctaatcagatatcctgagtcgtcccaattcttagaacttttatacctgtttttctccttctgttattccatttagtttctcaattcatccaaaaccgtgtccaggccatcaccaatcattctatacgacaaacttttcttctaacatccccacaatatcaccccttaccacaagacctcccttcagcttaatctctcccactctaggttcccacgccgccccaatcccgcttgaagcagccctgagaaacatcgcccattctctctccgtaccaccccccaaaaattttcgctgccccaacacttcaacactattttgttttatttttcttattaatataagagggcaggaatgtcaggcctctgagcccaagccaagccatcgcatcccctgtgacttgcacgtataagcccagatggcctgaagtaactgaagaatcacaaaagaagtgaatatgccctgccccaccttaactgatgacattccaccacaaaagaagtgtaaatggccggtccttgccttaagtgatgacattaccttgtgaaagtccttttcctggctcatcctggctcaaaaacacccccactgagcaccttgcgacccccactcctgcccgccagagaacaaaccccctttgactgtaattttcctttacctgcccaaatcctataaaacggccccactcttatctccctttgctgactctcttttcggactcagcccgcctgcacccaggtgaaataaacagccatgttgctcacacaaagcctgtttggtggtctcttcatacggacgcgcatgaaa

SEQ ID NO: 14 - DNA, 175 bp, Homo sapiens
gtcaggcctctgagcccaagctaagccatcatatcccctgtgacctgcacatatatatccagatcaccggaagcaactgaagatccacaaaagaagtgaaagtagccttaactgatgacattccaccattgtaatttgtttctgccccaccctaactgatcaatgtactttgtaa

SEQ ID NO: 15 - DNA, 9421 bp, Homo sapiens
gtggggaaaagcaagagagatcagattgttactgtgtctgtgtagaaagaagtagacataggagactccattttgttatgtactaagaaaaattcttctgccttgagattctgtgaccttacccccaaccccgtgctctctgaaatgtgtgctgtgtcaactcagagttaaatggattaagggcggtgcaggatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcctgacacccgtaaagggtctgtgctgaggaggattagtaaaagaggaaggaatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcactgagatgtttatgtgtatgcatatctaaaagcacagcacttaatcctttacattgtctatgatgccaagacctttgttcacatgtttgtctgctgaccctctccccacaattgtcttgtgaccctgacacatccccctctttgagaaacacccacagatgatcaataaatacgaagggaactcagaggctggcgggatcctccatatgctgaacgctggttccccgggtccccttatttctttctctatactttgtctctgtgtctttttcttttccaaatctctcgtcccaccttacgagaaacacccacaggtgtgtaggggcaacccacccctacatctggtgcccaacgtggaggcttttctctagggtgaaggtacgctcgagcgtggtcattgaggacaagtcgacgagagatcccgagtacgtctacagtcagccttacggtaagcttgtgcgctcggaagaagctagggtgataatggggcaaactaaaagtaaaattaaaagtaaatatgcctcttatctcagctttattaaaattcttttaaaaagagggggagttaaagtatctacaaaaaatctaatcaagctatttcaaataatagaacaattttgcccatggtttccagaacaaggaactttagatctaaaagattggaaaagaattggtaaggaactaaaacaagcaggtaggaagggtaatatcattccacttacagtatggaatgattgggccattattaaagcagctttagaaccatttcaaacagaagaagatagtatttcagtttctgatgcccctggaagcggtataatagattgtaatgaaaagacaaggaaaaaatcccagaaagaaaccgaaagtttacattgcgaatatgtagcagagccggtaatggctcagtcaacgcaaaatgttgactataatcaattacaggaggtgatatatcctgaaacgttaaaattagaaggaaaaggtccagaattagtggggccatcagagtctaaaccacgaggcacaagtcctcttccagcaggtcaggtgcctgtaacattacaacctcaaaagcaggttaaagaaaataagacccaaccgccagtagcctatcaatactggcctccggctgaacttcagtatcggccacccccagaaagtcagtatggatatccaggaatgcccccagcaccacagggcagggcgccataccctcagccgcccactaggagacttaatcctacggcaccacctagtagacagggtagtgaattacatgaaattattgataaatcaagaaaggaaggagatactgaggcatggcaattcccagtaacgttagaaccgatgccacctggagaaggagcccaagagggagagcctcccacagttgaggccagatacaagtctttttcgataaaaatactaaaagatatgaaagagggagtaaaacagtatggacccaactccccttatatgaggacattattagattccattgctcatggacatagactcattccttatgattgggagattctggcaaaatcgtctctctcaccctctcaatttttacaatttaagacttggtggattgatggggtacaagaacaggtccgaagaaatagggctgccaatcctccagttaacatagatgcagatcaactattaggaataggtcaaaattggagtactattagtcaacaagcattaatgcaaaatgaggccattgagcaagttagagctatctgccttagagcctgggaaaaaatccaagacccaggaagtacctgcccctcatttaatacagtaagacaaggttcaaaagagccctatcctgattttgtggcaaggctccaagatgttgctcaaaagtcaattgccgatgaaaaagcccgtaaggtcatagtggagttgatggcatatgaaaacgccaatcctgagtgtcaatcagccattaagccattaaaaggaaaggttcctgcaggatcagatgtaatctcagaatatgtaaaagcctgtgatggaatcggaggagctatgcataaagctatgcttatggctcaagcaataacaggagttgttttaggaggacaagttagaacatttggaggaaaatgttataattgtggtcaaattggtcacttaaaaaagaattgcccagtcttaaacaaacagaatataactattcaagcaactacaacaggtagagagccacctgacttatgtccaagatgtaaaaaaggaaaacattgggctagtcaatgtcgttctaaatttgataaaaatgggcaaccattgtcgggaaacgagcaaaggggccagcctcaggccccacaacaaactggggcattcccaattcagccatttgttcctcagggttttcagggacaacaacccccactgtcccaagtgtttcagggaataagccagttaccacaatacaacaattgtcccccgccacaagtggcagtgcagcagtagatttatgtactatacaagcagtctctctgcttccaggggagcccccacaaaaaatccctacaggggtatatggccccctgcctgaggggactgtaggactaatcttgggaagatcaagtctaaatctaaaaggagttcaaattcatactagtgtggttgattcagactataaaggcgaaattcagttggttattagctcttcagttccttggagtgccagtccaggagacaggattgctcaattattactcctgccatatattaagggtggaaatagtgaaataaaaagaataggagggcttggaagcactgatccaacaggaaaggctgcatattgggcaagtcaggtctcagagaacagacctgtgtgtaaggccattattcaaggaaaacagtttgaagggttggtagacactggagcagatgtctctatcattgctttaaatcagtggccaaaaaattggcctaaacaaaaggctgttacaggacttgtcggcataggcacagcctcagaagtgtatcaaagtatggagattttacattgcttagggccagataatcaagaaagtactgttcagccaatgattacttcaattcctcttaatctgtggggtcgagatttattacaacaatggggtgcggaaatcaccatgcccgctccattatatagccccacgagtcaaaaaatcatgaccaagaggggatatataccaggaaagggactagggaaaaatgaagatggcattaaaattccatttgaggctaaaataaatcaaaaaagagaaggaatagggtatcctttttaggggcggccactatagagcctcctaaacccataccattaacttggaaaacagaaaaaccggtgtgggtaaatcagtggccgctaccaaaacaaaaactggaggctttacatttattagcaaatgaacagttagaaaagggtcatattgagccttcgttctcaccttggaattctcctgtgtttgtaattcagaagaaatcaggcaaatggcgtatgttaactgacttaagggctgtaaacgccgtaattcaacccatggggcctctccaacccgggttgccctctccggccatgatcccaaaagattggcctttaattataattgatctaaaggattgcttttttaccatccctctggcagagcaggattgtgaaaaatttgcctttactataccagccataaataataaagaaccagccaccaggtttcagtggaaagtgttacctcagggaatgcttaatagtccaactatttgtcagacttttgtaggtcgagctcttcaaccagttaaagttttcagactgttatattattcattatattgatgatattttatgtgctgcagaaacgaaagataaattaattgactgttatacatttctgcaagcagaggttgccaatgctggactggcaatagcatctgataagatccaaacctctactccttttcattatttagggatgcagatagaaaatagaaaaattaagccacaaaaaatagaaataagaaaagacacattaaaaacactaaatgattttcaaaaattactaggagatattaattggatttggccaactctaggcattcctacttatgccatgtcaaatttgttctctatcttaagaggagactcagacttaaatagtaaaagaatgttaaccccagaggcaacaaaagaaattaaattagtggaagaaaaaattcagtcagcgcaaataaatagaatagatcccttagccccactccaacttttgatttttgccactgcacattctccaacaggcatcattattcaaaatactgatcttgtggagtggtcattccttcctcacagtacagttaagacttttacactgtacttggatcaaatagctacattaatcggtcagacaagattacgaataataaaattatgtggaaatgacccagacaaaatagttgtccctttaaccaaggaacaagttagacaagcctttatcaattctggtgcatggaagattggtcttgctaattttgtgggaattattgataatcattacccaaaaacaaagatcttccagttcttaaaattgactacttggattctacctaaaattaccagacgtgaacctttagaaaatgctctaacagtatttactgatggttccagcaatggaaaagcagcttacacagggccgaaagaacgagtaatcaaaactccatatcaatcggctcaaagagcagagttggttgcagtcattacagtgttacaagattttgaccaacctatcaatattatatcagattctgcatatgtagtacaggctacaagggatgttgagacagctctaattaaatatagcatggatgatcagttaaaccagctattcaatttattacaacaaactgtaagaaaaagaaatttcccattttatattactcatattcgagcacacactaatttaccagggcctttgactaaagcaaatgaacaagctgacttactggtatcatctgcactcataaaagcacaagaacttcatgctttgactcatgtaaatgcagcaggattaaaaaacaaatttgatgtcacatggaaacaggcaaaagatattgtacaacattgcacccagtgtcaagtcttacacctgcccactcaagaggcaggagttaatcccagaggtctgtgtcacgcatgtaccttcatttggaagattatcatatgttcatgtaacagttgatacttattcacatttcatatgggcaacttgccaaacaggagaaagtacttcccatgttaaaaaacatttattgtcttgttttgctgtaatgggagttccagaaaaaatcaaaactgacaatggaccaggatattgtagtaaagctttccaaaaattcttaagtcagtggaaaatttcacatacaacaggaattccttataattcccaaggacaggccatagttgaaagaactaatagaacactcaaaactcaattagttaaacaaaaagaagggggagacagtaaggagtgtaccactcctcagatgcaacttaatctagcactctatactttaaattttttaaacatttatagaaatcagactactacttctgcagaacaacatcttactggtaaaaagaacagcccacatgaaggaaaactaatttggtggaaagataataaaaataagacatgggaaatagggaaggtgataacgtgggggagaggttttgcttgtgtttcaccaggagaaaatcagcttcctgtttggatacccactagacctttgaagttctacaatgaacccatcagagatgcaaagaaaagcacctccgcggagacggagacaccgcaatcgagcaccgttgactcacaagatgaacaaaatggtgacgtcagaagaacagatgaagttgccatccaccaagaaggcagagccgccgacttgggcacaactaaagaagctgacgcagttagctacaaaatatctagagaacacaaaggtgacacaaaccccagagagtatgctgcttgcagccttgatgattgtatcaatggtggtaagtctccctatgcctgcaggagcagctgcagctaactataccaactgggcctatgtgcctttcccgcccttaattcgggcagtcacatggatggataatcctatagaagtatatgttaatgatagtgtatgggtacctggccccatagatgatcgctgccctgccaaacctgaggaagaagggatgatgataaatatttccattgggtatcgttatcctatttgcctagggagagcaccaggatgtttaatgcctgcagtccaaaattggttggtagaagtacctattgtcagtcccatctgtagattcacttatcacatggtaagcgggatgtcactcaggccacgggtaaattatttacaagacttttcttatcaaagatcactaaaatttagacctaaagggaaaccttgccccaaggaaattcccaaagaatcaaaaaatacagaagttttagtttgggaagaatgtgtggccaatagtgcggtgatattacaaaacaatgaatttggaactattatagattggacacctcaaggtcaattctaccacaattgctcaggacaaactcagtcgtgtccaagtgcacaagtgagtccagctgttgatagcgacttaacagaaagtttagacaaacataagcataaaaaattgcagtctttctacccttgggaatggggagaaaaaggaatctctaccccaagaccaaaaataataagtcctgtttctggtcctgaacatccagaattatggaggcttactgtggcctcacaccacattagaatttggtctggaaatcaaactttagaaacaagagatcgtaagccattttatactgtcgacctaaattccagtctaacacttcctttacaaagttgcgtaaagcccccttatatgctagttgtaggaaatatagttattaaaccagactcccagactataacctgtgaaaattgtagattgcttacttgcattgattcaacttttaattggcaacaccgtattctgctggtgagagcaagagagggcgtgtggatccctgtgtccatggaccgaccatgggaggcctcaccatccatccatattttgactgaagtattaaaaggtgttttaaatagatccaaaagattcatttttactttaattgcagtgattatgggattaattgcagtcacagctacggctgctgtagcaggagttgcattgcactcttctgttcagtcagtaaactttgttaatgatgggcaaaaaaattctacaagattgtggaattcacaatctagtattgatcaaaaattggcaaatcaaattaatgatcttagacaaactgtcatttggatgggagacagactcatgagcttagaacatcgtttccagttacaatgtgactggaatacgtcagatttttgtattacaccccaaatttataatgagtctgagcatcactgggacatggttagacgccatctacagggaagagaagataatctcactttagacatttccaaattaaaagaacaaattttcgaagcatcaaaagcccatttaaatttggtgccaggaactgaggcaattgcaggagttgctgatggcctcgcaaatcttaaccctgtcacttgggttaagaccattggaagtactacgattataaatctcatattaatccttgtgtgcctgttttgtctgttgttagtctgcaggtgtacccaacagctccgaagagacagcgaccatcgagaacgggccatgatgacgatggcggttttgtcgaaaagaaaagggggaaatgtggggaaaagcaagagagatcagattgttactgtgtctgtgtagaaagaagtagacataggagactccattttgttatgtactaagaaaaattcttctgccttgagattctgtgaccttacccccaaccccgtgctctctgaaatgtgtgctgtgtcaactcagagttaaatggattaagggcggtgcaggatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtaaaagaggaaggaatgcctcttgcagttgagacaagaggaaggcatctgtctcctgcctgtccctgggcaatggaatgtctcggtataaaacctgattgtatgctccatctactgagatagggaaaaaccgccttagggctggaggtgggacctgcgggcagcaatactgctttgtaaagcactgagatgtttatgtgtatgcatatctaaaagcacagcacttaatcctttacattgtctatgatgccaagacctttgttcacgtgtttgtctgctgaccctctccccacaattgtcttgtgaccctgacacatccccctctttgagaaacacccacagatgatcaataaatacgaagggaactcagaggctggcgggatcctccatatgctgaacgctggttccccgggtccccttatttctttctctatactttgtctctgtgtctttttcttttccaaatctctcgtcccaccttacgagaaacacccacaggtgtgtaggggcaacccacccctaca

SEQ ID NO: 16 - DNA, 7431 bp, Homo sapiens
cccctttgggtcccctccctttgtatgggagctctgttttcactctattcaatcttgcaactgcactcttctggtccgtgtttgttacggctcgagctgagctttctcccgccgtccaccactgctgctggctaccgtagcagacccaccgctgacttccatccctccggatccagcagggtgtccgctgtgctcctgatccagcgaggcgcccattgctgctcctgatcaggctagaggcttgccattgtgcctgcatgattaagtgctcaggttcgtcctaattgagctgaacactagtcactgggttccacggttctcttccatgacccacagcttctaatagagctataacactcaccgcatggccccagattccattccttggaatccgtgaggccaagaaccccaggttagagaatgcgaggcttgccaccatcttggaaagggcccaccaccatgttggaagcggcctgccaccatcttgggagctctgggagcaaggaccccccggtaacattttggcaaccatgaagggacctccaaagtggtgagtaatattggaccgctttcgcttgctgttctgtcttatccttccttagaattggaggaaaataccaggcacctgtcggccagttaaaaacaattagcatggccacaggacttaagactcaggtgtgaggctatctggggaagggctttctgacaacccccaatccttctgggttggggatggatgtctacctcaagccagcttccactttcagttttcttggggaagcccagggccgactagaggcagaaagctgtcgtcccgaactcccggcagtagctggttgagatcatggtgcagccagaagtctctactcaacagtcgcccatgcgtgcgcccctacctttccttctgacccatacctcctgggtcctgaccacgaatttcttgaaagtgtagccccaaaattctccttacctctgaatctacttcctctgatccctgcctcctaggtactaatggtccagacttttatttcctttagcaagttatatctccaaagggatctaaggaagctctacgctgcatccttaggcatctaggctataaacccagggagtcttatccctggtatccctcccgatttaggtatacagctctcaacatgggcagttatgtgggacccattccccaccacccttgccggggccccgagtttgtaatggctaagaggaggagagagagagacggaggagagagagacagaggagagacagagagagacagaggagagacagagagagacagaggagagacagagagagacagaggagagacagagagagacagaggagagagagagagatggaggagagagagagagggagacgaaggggagagacagagagacagagtcaaagaaaaaagagaaagatagaaatagtaaacaaaaacaaaaacaaaaacaaaaaacagtgtgccctattcctttaaaagccagggtaaatttaaaacctataattgataattgaaggtattctccgtgaccctataacactccaataccactttgttgtcagtgtaaataagggcgtagcccgaaagcactgaggccactgacaaccggtagccttcctatcaaaaatccttaacccaggaacctgcgggtggcccaaatgcattcaatctgtagcggcacctgctttgctaacagaagaaagtagaaaattaggctttagaggaaacctcattgtgagcacacctcaccggttcagaactatcctaagtcaaaaaagcaaaaaggtagcttactcaaaaatcttaaagtatggggctattctgttaaaaaaaaaaaggtaatttaacaacaaccactgataattcccttaacccagcagatttcctaacaggggatttaaatcttaattaccatacaaaggtccgaccagacctaggaggaattcccttcaggacaggaagacagatggttcctcccaggtgattgaggaaaaaaccacaatggttttcaattcaataattgatacggagactcctgtggaagcagagttagaaaaatcacctaataattggtcttctcaaacatgcgagctgtttgcactcagccaagccttccagaatcaaaagactatctcaaccctgactcaaaaggttacctacgccctctctgaaatgaatttgcataataactgcttttatgggaatgcatcttgttggggcagctgggttgttatgaaatactcaggaacccagcccaactctaggactcacccctgagcacaaaggcaatgttgggcacactggaaaaggaccactagaatccagcagcctggacccctttttttgtggtgaagaagggcgggaaaagaggttcaggactgctacatcggtgagcataactaatccgataagaagaggtccatgggtggttacacaccttggaaaggaactcacctctgagcgcaaaggcaatgttgggcactctggtaaatgaccactagaatccagcagcccaggcccctttctttgtggtcaagaaaggcaggaaaaggggtgcaggactgctacatcggtgagcataactaatctgataagcagaggtccatgggtggttgcgcattttggaaaagaataagcattaggcccttagaggatgctctaggactaatgctcattggaagatgactaggggtgctggcatccctatgttcttttttcagatgggaaatgttcccccgccccccaggcaaaaaatgcccctaagatgtattctggagaattgggaccaatttgaccctcagacactaagaaagaaacaacttatattcttctgcagtactgcctggccatgacatcctcttcaagggggagaaacctggcctcctgagggaagtataaattataacaccattttacagctagacctcttttgtagaaaagaaagcaaatggagtgaagtgccatatgtacaaactttcttttcattaagagacaactcacaattatgtaaaaagtgtgatttatgccctacaggaagccctcagagtctacctccctaccccagcatccccctgactccttctccaactaataaggaccccccttcaacccaaacagtccaaaaggagataaacaaaggggtaaacaatgaaccaaagagtgccaatattctgcgattatgccccctccaagcagtgggaggaggagaacttggcccagccagagtgcatgtacctttttctctctcagacttaaagcaaactaaaatagacctaggtaaattctcagataaccctgatggctatattgatgttttacaagggttaggacaatcctttgatctgacatggagagatataatgttactgctaaatcagacactaaccctgaatgagagaagtgccaccataactgcagcctgagagtttggcgatctctggtatctcagtcaggtcaatgataggatgacaagagaggaaagagaatgattccccacaggccggcaggcagttcccagtgtagaccctcattgggacacagaatcagaacatggagattagtgctgcagacatttgctaacttgtgtgctagaaggactaaggaaaactaggaagaagcctgtgaattattcaatgatgtccactataacacagggaaaggaagaaaatcctactgcctttctggagagactaagggaggcgttgaggaagcatccttccctgtcacctgacttattgaaggccaactaatcttaaaagataagtttatcactcagtcagctgcagacattagaaaaaaacttcaaaagtctgccttaggcctggagcaaaacttagaaaccctattgaacttggcaacctcagttttttataatagagatcaggaggagcaggtggaatgggacaaatggaattaaaaaaaggccactgctttagtcatagccctcaggcaagtggaatttggaggctctggaaaacggaaaagctgggcaaatcaaatgcctaatagggcttgcttccagtgcagtctacaaggacactttaaaaaagattgtccaggtagaaataaaccgccccctcatccgtgccccttatgtcaagggaatcactggaaggcccactgccccaggggatgaaggtcctctgagtcagaagccactaaccagatgatccagcagcaggactgagggtgcccggggcaagcaccagcccatgccatcaccctcacagagccccgggtatgcttgaccattgaggaccaggaggttaactgtctcctggacactggcgcagccttttcagtcttactttcctgtcccagacaactgtcctccagatctgtcactatccgaggggtcctaggacagccagtcactagatacttctcccagccactaagttgtgagtggggagctttctcttttcacatgcttttctaattatgcttgaaagccccactcccttgttagggagagacattctagcaaaagcaggggccattatacacctgaacataggagaaggaacactcgtttgttgtcccctgcttgaggaaggaattaatcctgaagtctgggcaacagaaggacaatatggaccagcaaagaatgcccatcctgttcaagttaaactaaaggattccacctcctttccctaccaaaggcagtacccccttagacccgaggcccaacaaggaccccaaaagattgttaaggacctaaaagctcaaggcctagtaaaaccatgcaatagcccctgcaatactccaattttaggaatacagaaacccaatggacagtggaggttagtgaaagatctcaggattatcaatgaggctgttttccctctatacccagctgtacctaacccttacactgtgctttctcaaataccagaggaagcagagcggtttagagtcctggaccttaaggatgcctttttctgcttccctatacatcctgactctcaattcttgtttgcctttgaagatcctttgaacccaacgtctcaacttacctggactgttttacctaagggttcagggatagcccccatctatttggccaggcattagcccaagacttgaaccaattatcatacctggacactcttgtcctttggtacgtggataatttacttttatccacccgttcagaaaccttgtgccatcaagccatccaagcactcttaaatttcctcgctacctgtggctacgagatttccaaaccaaaggctcagctctgctcacagcaggttaaatacttagggctaaaattatccaaaggcaccagggccctcagtgaggaatgtatcaagcctatactggcttatcctcatcccaaaaccctaaagcaactaagagggttccttggcataacaggtttctgccgaatatggattcccacgtacggcaaaatagccaggtcattatatacactaattaaggaaactcagaaagccaatacctatttagtaagatggacacctgaagcagaagcagctttccaggccctaaagagggccctaacccaagacccagtgttaagcttgccaacagggcaagacttttctttatatgtcacagaaaaaacaggaatagctctaggagtccttacacaagtctgagggacaagcttgcaacctgtggcatacctgagtaagcaaattgatgtagtggcaaagggttggcctcattgtttacgggtagtggtggcagtagcagtcttagtatctgaagcagttaaaataatacagggaagagatctcactgtgtggacatctcatgatgtgaatggcatactcactgctaaaggagacttgtggctgtcagacaacagtttacttaaatatcaggctgtattacttgaagggccagtgctgtgactgtgcacttgtgcaactcttaacccagccacatttctttcagacaatgaagaaaagatagaacataactgtcaacaagtaattgctcaaacataccctgctcaagggaaccttttagaggttcccttgactgatcccaacctcaacttgtatagtgatggaaattccttcgtaggaaaaggactttgaaaagtggggtatgcggtggtcagtgataatggaatacttgaaagtaatcccctcacttcaggaactagtgcttagctggcagaactaatagccctcactcgggcactagaattaggataaggaaaaagggtatatatatacacactctaagtatgcttacctagtcctccatgcccatacagcaatatggagagaaagggaattcctgacttctgagggaacacctatcaaacatcaggaagcctttaggaaattgttattggctgtacagaaacctaaagaggtggcagtcatatactgccagggtcatcagaaaggaaagggaaatagaagggagcagccaagtggatattgaagccaggagaactgcaaggcaggaccctccataagaaattcttatagaaggacctctagtatggggtaatcctctccgggaaaccaagccccagtactcagcaggagaaatagaatagggaacctcatgaggacatactttcctaccctcaggatggctagctaccgaagaaagaaaaatacttttgcctgcagctaaccaatagaaattacttaaaacccttcaccaaaccttcgacttagccattgatagcacccatcagatggccaaattattatttactggaccaggccttttcaaaactgtcaagcagatagtcagagcttgtaaagtgtgccaaaggaataatcccctgcactgcaggccatacatttcaatccctgtatctttaacctccttgttaagtttgtctcttccagaatcaaagctgtaaaactacaaatcattcttcaaatggagccccagatgcagtccatgactaagatctaccatgaacccctggaccagcctgctagcccatgctccgatgtcaatgacatcgaaggcacccctcccaaggaaatctcaactgcacaacccctactatgccccaatgcagcaagaagcagttagagcggtcattggccaacctccccaacagcacttgggttttcctgttgagggggggactgagagacaggactggctggatttcctaggccaactaagaatccataagcctagctgggaaggtgaccgcttccacctttaaacacggggcttgcaacttagctcacacccaaccaatcagatagtaaagagagctcactaaaacgctaattaggcaaaaacaggaggtaaagaaatagccaatcatctatcgcctgagagcacagtgggagggacaatgattgggatataaacccaggcatttgagccagcaacagcaaccccctttcggtcccctcacattgtatgggagctctgttttcactctattaaatcttgcaactgca

SEQ ID NO: 17 - DNA, 95 bp, Homo sapiens
tttggaaaaataggaccaaggaagctaaccaaagtcaacaccatgcacccaaatcctagcaagcatgagtatagccaccagttacctgggtgtgt

SEQ ID NO: 18 - DNA, 62 bp, Homo sapiens
tgggtcaggcacaaataagcccaccctcctaggaattatgttgaaaaatttcaaaaaaggat

SEQ ID NO: 19 - DNA, 3392 bp, Homo sapiens
gtcgtcaaatgggcaaatggtctgaggtgcctgacgtccaggcattcttttacacatcagtcccttcctagtctctgtgtccagtgcaacttgacccaaatcttccttctttccctcccgcctgtcccctcagtaccaaccccaagcgtcgctaagtctttctaatcttccttttctacagacccatctgacctctcccctcctcgacaggccgagctaggtcccaattcttcctcagcctccgctcctccaccctataatcattttatcgcctcccctcctcacgcctagtccggcttacagtttccttctgtgactagccctcccccacctgcccagcaatttatccttaaaaaggtggctggagctaaaggcatagtcaaggttaatgctcctttttctttatcccaaatcagatagcgtttaggctctttgtcatcaaatataaaaacccagcccagttcatggctcgttcggcagcaaccctgagacactttatagccctagaccctaaaaggtcaaaaggccgtcttattcttaatatacattttattacccaatctgctcccgacattaaataaaactccaaaaattaaattccggccctcaaaccccacaacaagatttaattaacctcgccttcaaggtgtacaataatagaaaaaagttgcaattccttgcctccactgtgagacaaaccccagccacatctccagcacacaagaacttccaaacacctgaaccgcagccgccaggtgttcctccagaacctcctctcccaggagcttcctacaagtgccagaaatctgaccaccaggccaaggaatgcctgcagcccaggattcctcctaagccgtgtcccatctgtgtaggacccctctggaaatcggactgttcaactcacctggcagccactcgcagagcccccggaactctggcctaagtctctctgactccttctcggcttagcggctgaagaccgacactgcccgatcacctcggaagccccctagaccatcacggacgcggagcttcgggtaactctcacactggaaggtaagtccgtccccgtgttaatcaatatggaagctacccactccacattaccttcttttcaagggcctgtttcccttgcctccataactgttgtaggtattgacggccaggcttctaaacctcttaaaactccccaactctggtgccaacttagacagtactcttttaagcactcctttttagttatccccacctgcccagttcccttattaggctgagacactttgactaaattatcggcttccctgtctactcctggactacagctatatctcattccgccattcttcccaatccaaagcctcctttgcgtcttcctcttgtatccccccaccttaacccacaagtataagatacctctactccctccttggcgaccgatcatgcaccccttaccatctcactaaaacctaatcacccttaccccactcaacaccaatatcccatcccgcagcacactttaaaaagattaaagcctgttatcactcacctgctagaggatggccttttaaaacctataaaatctccttacaattcccccattttacctgtcctaaaaccagacaagtcttacaatttagttcaggatctgcgccttatcaaccaaattgttttgcctatccaccccatggtgccaaacccatatactctcctatcctcaatacctgcctctacaacccattattctgttctagatctcaaacatgctttctttactattccgttgcgcccttaatcccagcctctcttcgctttcacttggactgaccctgacacacccatcaagctcagcaaattacctaggctgtactgccgcaaagcttcacagacagcccccattacttcaatcaagcccaaatttcttcctcatctgttacctatctcggcataattctcaaaaacacacgtgctctccctgccaatcgtgtccaactgatctctcaaacccaagcaccttctacaaaacaacaactcctttccttcctaggcatggttagcgcggtcagaattcttacacaacagccaggaccacaccctgtagcctttctgtccaaacaacttgaccttactgttttagcctagccctcatgtctgcgtgcagcggctgccgctgctttaatactttagaggccctcaaaatcacaaactgtgctcacctcactctctacagttctcataacttccaaaatctattttcttcctcatacctgatgcatatactttctgcttcccggctccttcagctgtactcattctttgttgagtctcccacaattaccgttgttcctggcccagacttcaatctggcctcccacattattcctgataccacacctgacccccatgactgtatctctctgatccacctgacattcaccccatttccccaaatttccttctttcctgttcctcaccctgatcacgcttgatttattgatggtggttccaccaggcctaatcgccacacaccagcaaaggcaggttatgctatagtacaaggcactagcccgcctcttagaacctctcatttcctttccatcatggaaatctatcctcaaggaaataacttctcagtgttccatctgctattctactactcctcaaggattattcaggccccctcccttccctacacatcaagctcgaggatttgcccccacccaggactggcaaattagctttactcaacttgtccggagtcaggaaactaaaatcttaatctctcccactcaaggtgcccacgccgcccctaatcccgcttgaagcagccctgagaaacatcgcccattctctctgcataccacccccccaaaaattttcgcctccccaacacttcaacactattttattttacttttattattactataagaaggcaggaatgtcaggcctctgagcccaagccaagccatcgcatcccctgtgacttgcacgtatacgcccagatggcctgaagtaactgaagaatcacaaaagaagtgaatatgccctgccccaccttaactgatgatattccaccacaaaagaagtgtaaatggccggtccttgccttaagtgatgacattaccttgtgaaattccttctcttggctcatcctggctcaaaaagcacccccactgagcaccttgccacccccactccagcccaccagagaacaaactccctttaactgtaattttcctttacctacccaaatcctataaaacggccccacccttatctcccttctctgactctcttttcggactcagcctgcctgcacccaggtgaaataaacagccatgttgctcacacaaagcctgtttggtggtctcttcacacggacgcgcatgaaa

SEQ ID NO: 20 - DNA, 3776 bp, Homo sapiens
tggggcaaactaaaagtaaaattaaaagtaaatatgcctcttatctcagctttattaaaattcttttaaaaagagggggagttaaagtatctacaaaaaatctaatcaagctatttcaaataatagaacaattttgcccatggtttccagaacaaggaactttagatctaaaagattggaaaagaattggtaaggaactaaaacaagcaggtaggaagggtaatatcattccacttacagtatggaatgattgggccattattaaagcagctttagaaccatttcaaacagaagaagatagcatttcagtttctgatgcccctggaagctgtttaatagattgtaatgaaaagacaaggaaaaaatcccagaaagaaacggaaagtttacattgcgaatatgtagcagagccggtaatggctcagtcaacgcaaaatgttgactataatcaattacaggaggtgatatatcctgaaacgttaaaattagaaggaaaaggtccagaattagtggggccatcagagtctaaaccacgagggccaagtcctcttccagcaggtcaggtgcccgtaacattacaacctcaaaagcagattaaagaaaataagacccaaccgccagtagcttatcaatactggccgccggctgaacttcagtatcggccacccccagaaagtcagtatggatatccaggaatgcccccagcaccacagggcagggcgccataccctcagccgcccactaggagacttaatcctacggcaccacctagtagacagggtagtgaattacatgaaattattgataaatcaagaaaggaaggagatactgaggcatggcaattcccagtaacgttagaaccgatgccacctggagaaggagcccaagagggagagcctcccacagttgaggccagatacaagtctttttcgataaaaatactaaaagatatgaaagagggagtaaaacagtatggacccaactccccttatatgaggacattattagattccattgctcatggacatagactcattccttatgattgggagattctggcaaaatcgtctctctcaccctctcaatttttacaatttaagacttggtggattgatggggtacaagaacaggtctgaagaaatagggctgccaatcctccagttaacatagatgcagatcaactattaggaataggtcaaaattggagtactattagtcaacaagcattaatgcaaaatgaggccattgagcaagttagagctatctgccttagagcctgggaaaaaatccaagacccaggaagtacctgcccctcatttaatacagtaagacaaggttcaaaagagccctatcctgattttgtggcaaggctccaagatgttgctcaaaagtcaattgccgatgaaaaagcccgtaaggtcatagtggagttgatggcatatgaaaacgccaatcctgagtgtcaatcagccattaagccattaaaaggaaaggttcctgcaggatcagatgtaatctcagaatatgtaaaagcctgtgatggaatcggaggagctatgcataaagctatgcttatggctcaagcaataacaggagttgttttaggaggacaagttagaacatttggaggaaaatgttataattgtggtcaaattggtcacttaaaaaagaattgcccagtcttaaataaacagaatataactattcaagcaactacaacaggtagagagccacctgacttatgtccaagatgtaaaaaaggaaaacattgggctagtcaatgtcgttctaaatttgataaaaatgggcaaccattgtcgggaaacgagcaaaggggccagcctcaggccccacaacaaactggggcattcccaattcagccatttgttcctcagggttttcagggacaacaacccccactgtcccaagtgtttcagggaataagccagttaccacaatacaacaattgtccctcaccacaagcggcagtgcagcagtagatttatgtactatacaagcagtctctctgcttccaggggaacccccacaaaaaatccctacaggggtatatggccccctgcctgaggggactgtaggactaatcttgggaagatcaagtctaaatctaaaaggagttcaaattcatactagtgtggttgattcagactataaaggcgaaattcagttggttattagctcttcaattccttggagtgccagtccaggagacaggattgctcaattattactcctgccatatattaagggtgaaaatagtgaaataaaaagaataggagggcttggaagcactgatccgacaggaaaggctgcatattgggcaagtcaggtctcagagaacagacctgtgtgtaaggccattattcaaggaaaacagtttgaagggttggtagacactggagcagatgtctctatcattgctttaaatcagtggccaaaaaattggcctaaacaaaaggctgttacaggacttgtcggcataggcacagcctcagaagtgtatcaaagtacggagattttacattgcttagggccagataatcaagaaagtactgttcagccaatgattacttcaattcctcttaatctgtggggtcgagatttattacaacaatggggtgcggaaatcaccatgcccgctccattatatagccccacgagtcaaaaaatcatgaccaagaggggatatataccaggaaagggactagggaaaaatgaagatggcattaaagttccagttgaggctaaaataaatcaagaaagagaaggaattagggtatcctttttaggggcggccactgtagagcctcctaaacccataccattaacttggaaaacagaaaaaccggtgtgggtaaatcagtggccgctaccaaaacaaaaactggaggctttacatttattagcaaatgaacagttagaaaagggtcatattgagccttcgttctcaccttggaattctcctgtgtttgtaattcagaagaaatcaggcaaatggcgtatgttaactgacttaagggctgtaaacgccgtaattcaacccatggggcctctccaacctgggttgccctctccagccatgatcccaaaagattggcctttaattataattgatctaaaggattgcttttttaccatccctctggcagagcaggattgtgaaaaatttgcctttactataccagccataaataataaagaaccagccaccaggtttcagtggaaagtgttacctcagggaatgcttaatagtccaactatttgtcagacttttgtaggtcgagctcttcaaccagttagagaaaagttttcagactgttatattattcattatattgatgatattttatgtgctgcagaaacgaaagataaattaattgactgttatacatttctgcaagcagaggttgccaatgctggactggcaatagcatctgataagatccaaacctctactccttttcattatttagggatgcagatagaaaatagaaaaattaagccacaaaaaatagaaataagaaaagacacattaaaaacactaaatgattttcaaaaattactaggagatattaattggattcggccaactctaggcattcctacttatgccatgtcaaatttgttctctatcttaagaggagactcagacttaaatagtaaaagaatgttaaccccagaggcaacaaaagaaattaaattagtggaagaaaaaattcagtcagcgcaaataaatagaatagatcccttagccccac

SEQ ID NO: 21 - DNA, 778 bp, Homo sapiens
gagagacaggactagctggatttcctaggccgactaagaatccctaagcctagctgggaaggtgaccacatccacctttaaacatggggcttgcaacttagctcacacccgaccaatcaggtaggaaagagagatcactaaaatgctgattaggcaaaaacaggaggtaaagaaatagccaatcatctattgcctgagagcacaaccggagggacaatgatcgggatataaacccaggcattcaagccggcaatggctaccctctttgggtcccctccctttgtatgggagctctgttttcactctattaaatcttgcaactgcactcttctggtccgtgtttgttagggctcaagctgagcttctacttgccttccaccactgctgtttgcagtcatcgcagacccgccgctgacttccatccctccggatatggcagggtgtccgctgtgctcctgatccagggaggcgcccattgccgctcctgatcaggctagaggcttgctgttgttcctgcatggctaagtgcctgggtttgtcctaatcaagctgaacaccagtcactgggttccatggttctcttccatgacccacggcatctaatagagcgataacactcatcgcatggcccaagattccattccttggaatccgtgaggccaagaaccccagatcagagaacatgaggcttgccaccatcttggaagcagcccgccacctttttggaagcggcccgccaccatcttgggagctctgggagcaagaacccccggtaaca

SEQ ID NO: 22 - DNA, 5271 bp, Homo sapiens
gactgagatcgggggacctcccttgggagatcaatcccttcctcttgttctttgctccatgagaaagatccacctatgacctcaggtcctcagaccaaccagcccaagaaacatgtcaccaatttcaaatctggtaagcggcctctttttactctcttctccaagctccctcactatccctccacctctttctcctttcaatcttggcgccacacttcaatctctcccttctcttaatttcaattcctttcaattcctttggtagagacaaaggagacacgttttatctgtggacccaaaactcctgcaccggtcacggactgggaaggcagccttcccttggtgtttaatctttgcagggatgcctctctgattgttcacccacgtttcaaagctgtcacaccatacagggacgcctgccttggtccttcacccttagcggcaagtcccgctttcctgggggaggggcaagaaaccctcaaccccttctccttcacccttagtggcaagtcccgctttcctggggcaggggcaagtacccctcaaccccttctccttcacccttagcggcaagtcccgctttcctagggggcaagaaccccccagtcgcttatttccccatcccaacctcttatctctgagccccaatcccttacatccacaccctgacctcttatctctgtgccccaatcccttatttccatgccccaaccccttctctgcttttctggagggcaagaaccccccaccccttctccgtgtctctactcttttctctgggcttgcctccttcactatgggtaagcttccaccttccattcctccttcttctcccttagcctgtgttctcaaaaacttaaaacctcttcaactcacacctgacctaaaacttaaatgacttattttcttctgcaatgctgcttgaccccaatacaaactcgacagtagttccaaatagccaggaaatggcactttcaatttttccatcctacaagatctaaataattcttgtcataaaatgggcaaatggtctgaggtgcctgacatccaggcattctttcacgcatcagtcccttcctagtctctgtgcccaatgcaactcgtcccaaatcttccttctttccctccctcctgtcccctcagtcccaaccccaagtgtcgctgggtctttctaatcttccttttatacagacccatctgacctctcccctcctcgccaggctgagccaggtcccaattcttcctcagcctccgctcctccaccctgtaatctttttatcacctcccctcctcacacctggtccaacttacagtttttattcagtgactagccctctcccacctgcccagcaatttactcttaaaaaggtggctggagctaaaggcatagtcaaggttaatgctcctttttctttatcccaaatcagagagcgtttaggctctttttcatcaaatataaaaattcagcccagttcatgactcgtttgacagcaaccctgagacactttacagccctaggccctaaaaggtcaaaaggctgtcttattctcaaaatacattttattacccaatctgctcccgacattaaataaaactccaaaaattaaattccgaccctcaaaccccacaacaggatttaattaacctcgccttcaaggtgtacaataatagaaaaaagttgcaattccttgcctccactgtgagacaaaccccagccacatctccagcacacaagaacttccaaatgcctgaaccgcagcagccaggcgttcctccagaacctcctcccccaggagcttgctacaagtgccagaaatctgaccaccaagcaaaggaatgcctgaagcccaggattcctcctaagccatgtcccatctgtgcgggaccccactggaaatcggactgttcaactcacctggcagccactcccagagcccctggaactctggcccaaggcgctctgactgactccttctcggcttagcagctgaagactgacgctgcctgatcgcctcggaagccccctagaccatcacggacgccgagcttcaggtaactctcacagtggaaggtaagcccgtccccttcttaatcaatacggaggctacccactccacattaccttcttttcaagggcctgtttcccttgcctccagaactgttgtgggtattgacggccaggcttctaaacctcttaaaactccccaactctggtgccaactgagacagtactcttataagcactcctttttagttatccccacctgcccagttcccttattaggctgagacatgttaactaaattatctgcttccctgactattcctggactacagctatatatcattgccgcccttcttcccaatcaagagcctcctttgcatcctcctcttgtatccccccaccttaacccacaagtataagatacctctactccctccttggtgactgatcatgcaccccttaccatctcattaaaacctaatcacccttaccccactcaacgccaatatcccatcccgaagcacactttaaaaagattaaagcctgttatcactcgcctgctacagcatggccttttaaaacctataaactctccttacaattcccccattttaccagtcctaaaaccagacaagccttacaatttagttcaggatctgcgccttatcaaccaaattgttttgcctatccaccccgtcgtgccaaacccatatactctcctatcctcaatacctgcctctacaacccattattctgttctagatctcaaacatgctttctttactattcctttgcacccttaatcccagcctctcttcgctttcacttggactgaccctgacaccgatcaagctcagcaaattacctaggctgtactgccgcaaagcttcacagacagcccccattacttcaatcaagcccaaatttcttcctcatctgttacctatcttggcataattctcataaaaacacacgtgctctccctgccaatcgtgtccgactgatctctcaaacccaagcaccttctataaaacaacaactcctttccttcgtaggcatggttagcgcggtcagaattcttacacaagagccaggacaacaccctgtagcctttctgtccaaacaacttgaccttactgttttagcccagccctcatgtctgcatgcagcggctgccactgctttaatacttttaaaggccctcaaaatcacaaactatgctcaactcactctctacagttctcataacttccaaaatctattttcttcctcatacctgacacatacactttctgcttcccggctccttcagctgtactcactctttgttaagtcccacaattaccattgttcctggcccagacttcaatccggcctcccacattattcctgataccacacctgacccccatgactgtatctctgtgatccacctgacattcaccccatttccccaaatttccttctttcctgttcctcaccctgatcacacttgatttattgatggcggttccaccaggcctaattgccacacaccagcaaaggcaggttatgctatagtacaagccactagcccgcctcttagaacctctcatttcctttccatggtggaaatctatcctcaaggaaataacttctcagtgttccatctgctattctactactcctcagggattattcaggccccctcccttccctacacatcaagctcgaggatttgccccacccaggactggcaaattagctttactcaacatgcccccagtcagaaaactaaaatacctcttagtctaggtagatactttcactggataggtacaggcctttcctacagggtctgagaaggccaccacagtcatttcttcccttctgtcagacataattcctcagtttagccttcccaccctcaatacagtctgataacagatgagcctttattagtcaaatcagccaagcagtttttcaggctcttagtattcagtgaaacctttatatcccttacgatcctccgtcttcaagaaaagtagaatggactaaaggtcttttaaaaacacacctcaccaagctcagccaccaacctaagaaggactggacaatacttttaccactttcccttctcagaagtcagacctgtcctcagaatgctacaaggtacagcccatttaagctcctgtatagacactccttttattaggccccagtctcattccagacaccagaccaacttagactgtgcgccccccaaaaaaacttgtcatccccactatcttctgtctagtcatactcctattcaccattctcaactattcatacatgccctgctcttgtttacactgccggtttacactgtttctccaagccatgacagctgatatctcctggtgctatccccaaactgccactcttaactcttgaagtaaataaataatctttgctggcaggactatgctgaatctccttaggcactctctaatcagatgtcccgggtcctcccaattcttagtcctttaatacccatttttctccttttattcggaccttgtatcttccgtttagtttctcggttcattcaaaaccgtatccaggccatcaccaatcattctatacgacaaatgtttcttctaacatccccacaatatcatcccttaccacaagatctcccttcagcttaatctctcccactctagtttcccacgccgaccctaatcccgcttgaagcagccctgagaaacatcgcccattctctctccataccatccccccaaaattttcaccaccccaacacttcaacactattttgttttatttttcttattaatataagaagacaggaatgtcaggcctctgagctcaagccaagccatcgcatcccctgtgacttgcacatatacatccagatggcctgaagtaactgaagatccacaaaagatgtaaaaatagtcttaactgatgattttccaccattgtgatttgttcctgccccaccctaactgatcaatgtactttgtaatctcccccactcttaagaaggttctttgtaattctccccacccttgagaatgtactttgtgagatccacccctgcccacaaaacattgctcttaatttcaccgcctatcccaaaacctgtaagaactaatgataatccatctcccttcgctgactctcttttcagactcagcccaacctgcacccaggtgaaataaacagctttactgctcacacaaagcctgtttggtggtctcttcacacggacgcgcatgaaa

SEQ ID NO: 23 - DNA, 9445 bp, Homo sapiens
gtggggaaaagcaagagagatcagattgttactgtgtctgtgtagaaagaagtagacataggagactccattttgttatgtactaagaaaaattcttctgccttgagattctgtgaccttacccccaaccccgtgctctctgaaacatgtgctgtgtcaactcagagttgaatggattaagggcagtgcaagatgtgctttgttaaacagatgcttgaaggcagcatgctccttaagagtcatcaccactccctcatctcaagtacccagggacacaaaaactgcggaaggccgcagggacctctgcctaggaaagccaggtattgtccaaggtttcatagtctgaaatatggcctcgtgggaagggaaagacctgactgtcccccagcccgacacccataaagggtctgtgctgaggaggattagtataagaggaaggcatgcctcttgcagttgagacaagaggaaggcatctgtctcctgcctgtccctgggcaatggaatgtctcagtataaaacccgattgtatgctccatctactgagatagggaaaaactgccttagggctggaggtgggacctgcaggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctctttgagaaacacccacgaatgatcaataaatactaagggaactcagaggctggcgggatcctccatatgctgaacgctggttccctaggtccccttatttctttctctatactttgcctctgtgtctttttctttcctaagtctctcattccacctttacgagaaacacccacaggtgtggaggggcaacccacccctacatctggtgcccaacgtggaggcttttctctagggtgaaggtacgctcgagcatggtcattgaggacaagtcgacgagagatcccgagtacgtctacagtcagcctttcggtaagcttgtgcgcttggaagaagctagggtgataatggggcaaactaaaagtaaaattaagagtaaatatgcctcttatctcagctttattaaaattcttttaaaaagagggggagttaaagtatctacaaaaaatctaatcaagctatttcaaataatagaacaattttgcccatggtttccagaacaaggaactttagatctaaaagattggaaaagaattggtaaggaactaaaacaagcaggtaggaagggtaatatcattccacttacagtatggaatgattgggccattattaaagcagctttagaaccatttcaaacagaagaagatagtgtttcagtttctgatgcccctggaagctgtttaatagattgtaatgaaaagacaaggaaaaaatcccagaaagaaatggaaggtttacattgcgaatatgtagcagagccggtgatggctcagtcaacacaaaatgttgactataatcaattacaggaggtgatatatcctgaaacgttaaaattagaaggaaaaggtcccgaattagtggggccattagagtctaaaccatgaggcacaagtcctcttccagcaggtcaggtgcctgtaacattacaacctcaaacgcaggttaaagaaaataagacccaaccgccagtagcctatcaatactggctgccggctgaacttcagtatcggccacccccagaaagtcagtatggatatccaggaatacccccagcaccacagggcagggtgccataccctcagccacccactaggagacttaatcctatggcaccacctagtagacagggtagtgaattacatgaaattattgataaatcaagaaaggaaggagatactgaggcatggcaattcccagtaacgttagaaccgatgccacctggagaaggagcccaagagggagagcctctcacagttgaggccagatacaagtctttttcgataaaaatgctaaaagatatgaaagagggagtaaaacagtatggacccaactccccttatatgaggacattattagattccattgctcatggacatagactcattccttatgattgggagattctggcaaaatcgtctctctcaccctctctatttttacaatttaagacttggtggattgatggggtacaagaacaggtccgaagaaatagggctgccaatcctccagttaacatagatgcagatcaactattaggaacaggtcaaaattggagtactattagtcaacaagcgttaatgcaaaatgaggccattgagcaagttagagctatctgccttagagcctgggaaaaaatccaagacccaggaagcgcctgcccctcatttaatacagtaagacaaggttcgaaagagccctaccttgattttgtggcaaggctccaagatgttgctcaaaagtcaattgccaatgaaaaagcccataaggtcatagtggagttgatggcatatgaaaacgccaatcttgagtgtcaatcagccattaagccattaaaagcaaaggttcctgcaggatcagatgtaatctcagaatatgtaaaagcctgtgatggaatcggaggagctatgcataaagctatgcttatggctcaagcaataacaggagttgttttaggaggacaagttagaacatttggaggaaaatgatataattgtggtcaaattggtcacttaaaaaagaactgcccagtcttaaataaacagaatataactattcaagctactaccacaacaggtagagagccagctgacttatgtccaagatgtaaaaaaggaaaacattgggctagtcaatgttgttctaaatttgataaaaatgggcaaccattgtcgggaaatgagcaaaggggccagcctcaggccccacaacaaactggggcattcccaattcagccatttgttcctcagggttttcagggacaacaacccccactgtcccaagtgtttcagggaataagccagttaccacaatacaacaattgtcccccgccacaagcggcagtgcagcagtagatttatgtactatacaagcagtctctctgcttccaggggagcccccacaaaaaatccccacaggggtatatggcccactgcctgaggggactgtaggactaatcttgggaagatcaagtctaaatctaaaaggagttcaaattcatactagtgtggtagatacagactataaaggtgaaattcaattggttattagctcttcagttccttggagtgccagtccaggagacaggattgctcaattattactcctgccatacattaagggtggaaatagtgaaataaaaagaataggagagtttggaagcactgatccgacaggaaaggctgcatattgggcaagtcaggtctcagagaacagacctgtgtgtaaggccattattcaaggaaaacagtttgaagggttggtagacactgaagcagatgtctctatcattgctttaaatcagtggccaaaaaattggcctaaacaaaaggctgttacaggacttgtcggcataggcacagcctcagaagtgtatcaaagtactgagattttacattgcttagggccagataatcaagaaagtactgttcagccaatgattacttcaattcctcttaatctgtggggtcaagatttattacaacaatggggtgtggaaatcaccatgcccgctccattatatagccccacgagtcaaaaaatcatgaccaagatgggatatataccaggaaagggactagggaaaaatgaagatggcattaaagttccagttgaggctaaaataaatcaaaaaagagaaggaatagggtatcctttttaggggcggccactgtagagcctcctaaacccataccattaacttggaaaacagaaaaaccggtgtgggtaaatcagtggccgctaccaaaacaaaaactggaggctttacatttattagcaaatgaacagttagaaaagggtcatattgagccttcattctcgccttggaattctcctgtgtttgtgattcagaagaaatcaggcaaatggcgtatgttaactgacttaagggccgtaaacgccataattcaacccatggggcctctccaatctgggttgccctctccggccatgatcccaaaagattggcctttaattataattgatctaaaggattgcttttttaccatccctctggcggagcaggattgcgaaaaatttgcctttactatactagccataaataataaagaaccagccaccaggtttcagtggaaagtgttacctcagggaatgcttaatagtccaactatttgtcagacttttgtaggtcgagctcttcaaccagttagagacaagttttcagactgttatattattcattatattgatgatattttatgtgctgcagaaacgaaagataaattaattgactgttatacatttctgcaagcagaggttgccaacgcaggactggcaatagcatctgataagatccaaacctctactccttttcattatttagggatgcagatagaaaatagaaaaattaagccacaaaaaatagaaataagaaaatacacattaaaaacactaaatgattttcaaaaattgctgggagatattaattggattcggccaactctaggcattcctacttatgccatgtcaaatttgttctctatcttaagaggagactcagacttaaatagtaaaagaatgttaaccccagaggcaacaaaagaaattaaattagtggaagaaaaaattcagtcagtgcaaataaatagaatagatcccttagccccactccaacttttgatttttgccactgcacattctccaacaggcatcattattcaaaatactgatcttgtggagtggtcattccttcctcacagtacagttaagacttttacattgtacttggatcaaatagctacattaattggtcagacaagattacgaataataaaattatgtggaaatgacccagacaaaatagttgtccctttaaccaaggaacaagttagacaagcctttatcaattctggtgcatggcagattggtcttgctaattttgtgggaattattgataatcattacccaaaaacaaagatcttccagttcttaaaattgactacttggattctacctaaaattaccagacatgaacctttagaaaatgctctaacaatatttactgatggttccagcaatggaaaagcagcttacacagggccgaaagaatgagtaatcaaaactccatatcaatcagctcaaagagcagagttggttgcagtcattaaagtgttacaagattttgaccaacctatcaatattatatcagattctgcatatgtagtacaggctacaagggatgttgagacagctctaattaaatatagcatggatgatcagttaaaccagctattcaatttattacaacaaactgtaagaaaaagaaatttcccattttatattactcatattcgagcacacactaatttaccagggcctttgactaaagcaaatgaacaagctgacttactggtatcatctgcattcataaaagcacaagaacttcatgctttgactcatgtaaatgcagcaggattaaaaaacaaatttgatgtcacatggaaacaggcaaaagatattgtacaacattgcacccagtgtcaagtcttacacctgcccactcaagaggcaggagttaatcccagaggtctgtgtcctaatgcattatggcaagtggatgtcacgcatgtaccttcatttggaagattatcatatgttcatgtaacagttgatacttattcacatttcatatgggcaacttgccaaacaggagaaagtacttcccatgttaaaaaacatttattgtcttgttttgctgtaatgggagttccagaaaaaatcaaaactgacaatggaccaggatattgtagtaaagctttccaaaaattcttaagtcagtggaaaatttcacatacaacaggaattccttataattcccaaggacaggccatagttgaaagaactaatagaacactcaacactcagttaaacaaaaagaagggggagacagtaaggagtgtaccactcctcagatgcaacttaatctagcactctatactttaaattttttaaacatttatagaaatcagactactacttctgcagaacaacatcttactggttaaaagaacagcccacatgaaggaaaactaatttggtggaaagataataaaaataagacatgggaaatagggaaggtgataacgtgggggagaggttttgcttgtgtttcaccaggagaaaatcagcttcctgtttggatacccactagacatttgaagttctacaatgaacccatcggagatgcaaagaaaagcacctccgcggagacggagacactgcaatcgagcaccgttgactcacaagatgaacaaaatggtgacgtcagaagaagagatgaagttgccatccaccaagaaggcagagccgctgacttgggcacaactaaagaagctgacgcagttagctacaaaatgtctagagaacacaaaggtgacacaaaccccagagagtatgctgcttgcagccttgatgattgtatcaatggtggtaagtctccctatgcctgcaggagcagctgcagctaactatacctactgggcctatgtgcctttcccgcccttaatttgggcagtcacatggatggataatcctatagaagtatatgttaatgatagtgtatgggttcctggccccacagatgatcgctgccctgccaaacctgaggaagaagggatgatgataaatatttccactgggtatcgttatcctcctatttgcctagggagagcaccaggatgtttaatgcctgcagtccaaaattggttggtagaagtacctactgtcagtcccatcagtagattcacttatcacatggtaagcgggatgtcactcaggccacgggtaaattatttacaagacttttcttatcaaagatcattaaaatttagacctaaagggaaaccttgccccaaggaaattcccaaagaatcaaaaaatacagaagttttagtttgggaagaatgtgtggccaatagtgcagtgatattacaaaacaatgaatttggaactattatagattgggcacctcgaggtcaattctaccacaattgctcaggatgaactcagtcgtgtccaagtgcacaagtgagtccagctgttgatagcgacttaacagaaagtttagacaaacataagcataaaaaattgcagtctttctacccttgggaatggggagaaaaaggaatctctaccccaagaccaaaaataataagtcctgtttctggtcctgaacatccagaattatggaggcttactgtggcctcacaccacattagaatttggtctggaaatcagactttagaaacaagagatcataagccattttatactatcgacctaaattccagtctaacggttcctttacaaagttgcgtaaagcccccttatatgctagttgtaggaaatatagctattaaaccagactcccagactataacctgtgaaaattgtagattgcttacttgcattgattcaacttttaattggcaacaccgtattctgctggtgagagcaagagagggcgtgtggatccctgtgtccatggaccgaccgtgggaggcctcgccatccatccatattttgactgaagtattaaaaggtgttttaaatagatccaaaagattcatttttactttaattgcagtgattatgggattaattgcagtcacagctatggctgctgtagcaggagttgcattgcactcttctgttcagtcggtaaactttgttaatgattggcaaaaaaattctacaagattgtggaattcacaatctagtattgatcaaaaattggcaaatcaaattaatgatcttagacaaactgtcatttggatgggagacagactcatgagcttagaacatcgtttccagttacagtgtgactggaatatgtcagacttttgtattacaccccaaatttataatgagtctgagcatcactgggacatggttagacggcatctacagggaagagaagataatctcactttagacatttccaagttaaaagaacaaattttcgaagcatcaaaaacccatttaaatttggtgccaggaactgaggcaattgcaggagttgctgatggcctcgcaaatcttaaccctgtcacttgggttaagaccatcggaagtactacaattataaatctcatattaatccttgtgtgcctgttttgtctgttgttagtctgcaggtgtaaccaacagctccaaagagacagcgaccatcgagaacgggccatgattacgatggtggttttgtcgaaaagaaaagggggaaatgtggggaaaagcaagagcgatcagattgttgctgtgtctgtgtagaaagaagtagacataggagactccattttgttatgtactaagaaaaattcttctgccttgagattctgtgaccttacccccaaccccatgctctctgaaacatgtgctgtgtcaactcagagatgaatggattaagggcggtgcaagatgtgctttgttaaacagatgcttgaaggcagcatgctccttaagagtcatcaccactccctcatctcaagtacccagggacacaaaaactgcggaaggctgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtataagaggaaggcatgcctcttgcagttgagacaagaggaaggcatctgtctcctgcctgtccctgggcaatggaatgtctcgttataaaacccgattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctctttgagaaacacccacgaatgatcaataaatactaagggaactcagaggctggcgggatcctccatatgctgaacgctggttccccggatccccttatttctttctctatactttgtctctgtgtctttttctttcctaagtctctcattccaccttacgagaaacacccacaggtgtggaggggcaacccacccctaca

SEQ ID NO: 24 - DNA, 5337 bp, Homo sapiens
gtcaggcctctgagcccaagctaagccatcatatcccctgtgacctgcacatacacatccagatggccggttcctgccttaattgatgacattccaccacaaaagcagtgaaaatggcctgttcctgccttaactgatgacgtcaccttgtgaaattccttctcctggctcatcctggctcaaaagctcccctactgagcaccctgtgacccccactcctgcccatcagagaacaacccccctttttcctttaccttcccaaatcctataaaacggccccaccccatctcccttcgctctcttttcagactcagcctgcctgcacccaggtgaaataaacagccttgttgctcacacaaagcctgtttggtggtctcttcacacagacacgagtgaaatttggtgccgtgactcgaatcgggggacctcccttaggagatcaatcccctgtcctcctgctctttgctccgtgagaaagatccacctacgacctcaggtcctcagaccgaccagcccaagaaacatctcaccaatttcaaatccagtaagcggcctctttttactcccttctccaacctccctcactatccctcaacctctttctcctttcaatcttggtgccacccttcaatctctcccttctcttaatttcaattcctttcattttctagtagagacaaaggagacacgttttatccatggactcaaaactctggcactggtcacggactagggaaggcagccttcccttggtgtttaatcattacaggaacgcctctctgattatttactcaggtttcagaggtgtcagaccacgcaaggatgcctgccttggtacttcacccttagcggcaagtcccgcttttataaaggaaaggcaagaacccctcaaccccttctccttcacccttagcggcaagtcccgcttttctggaggagaggcaagaaccctgacctcttatccctatgccccgatcccttatttctgtgcccggacctcttatctctgcgccctgatcccttatttccacgccccgacctcttatctctgcaccccaaccccttctctgcttttctggaaggcaagaaccccccccccccgccccccgaccccttctccgtgtctctactctcttttctctgggcttgcctccttcactataggcaagcttccacctccattcctccttcttctcccttagcctatgttcttaagaacttaaaacctcttcaactctcacctgacctaaaatctatgcgtcttattttcttctgaaatgccgcttgaccccaatacaaactcaacagtagttccaaatagccagaaaacggcactttcaatttttccatcctacaatatctaaataattcttgtcgtaaaataggcaaatggtttgaggtgcctgacgtccaggcattcttttacacatcaggccctccctagtctctgttcccaatacaacttgtcccaaatcttccttctttccctcccgcctgtcccctcagtaccaaccccaagcgtcgttaagtctttctaatcttccttttctacagacctatctgacctctcccctcctcaccaggccgagctaagtcccaattcttactcagcctccgctcctccaccctataatccttttatcacctcccctcctcacactcggtccggcttacagtttcgttctgtgactagccctccccctcctgcccagcaatttactcttaaaaaggtggctggagctaaaggcatagtcaaggttaatgcttctttttctttatcccaaatcagaagcgtttaggctctttttcatcaaatataaaaacccagcccagttcatgacttgttcggcagcaaccctgagacgctttacagccctagaccctaaaaggtcaaaaggccatcttattctcaatatacattttattacccaatctgctcccgacattaaataaaactccaaaaattaaattccagtcctcaaaccccacaacaggatttaattaacctcgccttcaaggtgtacaataatagaaaaaagttgcaattccttgcctccactctgagacaaaccccagccacatctccagcacacaagaacttccaaatgcctaaaccacagtggccaggcgttcctccagaaccgcctcccccaggagcttgctacaagtgccagaaatctggccaccaggccaaggaatgcccgcagcccaggattcctcctaagccgcgtcccatctgtgcaggaccccactagaaatcggactgttcaactcacctggcagccactcccagagcccctggaactctggcccaaggctctctgactgactccttcccagatcttctcggcttagcagctgaagactgatgctgcccgatcacctcagaagccctgtagaccatcacagacgccaagctttaagtaactctcacagtggaaggtaagtccttccccttcttaatcaatacggaggctacccactccacattaccttcttttcaagggcctgtttcccttgcctccataactgttgtgggtattgacggccaggcttctaaacctcttaaaactcctcaactctggtgccaacttagacaatactcttttaagcactcctttttacttatccccacctgcccagttcccttattaggctgagacactttaactaaattatctgcttccctgactattcccggactacagctacatctcattgccgcccttcttcccaatccaaagcctcctttgcatcctcctcttgtatcccccccaccttaacccacaagtataagatacctctactccctccttagtgaccgatcatgcgccccttaccatctcattgaaacctaatcacccttacctcgctcaatgccaatatcccatcccacagcacgctttaaaaagattaaagcctgttatcactcgcctgctacagcatggccttttaaagcctataaactctccttacaattcccccattttacctgtcctaaaaccagacaagacttacaagttagttcaagatctgtgccttatcaaccaaattgttttgcctatccagcccgtggtgccaaacccatatactctcctatcctcaatacctccctccacaatccattattctgttctagatctcaaacatgctttctttactattcctttgcacccttcatcccagcctctcttcgctttcacttagactgactctgacaccaatcaggctcagcaaattacctgggctgtactgccgcaaagcttcacagacagcccccattacttcagtcaagcccaaatttcttcctcatctgttacccatctcagcataattctcgtaaaaacacatgtgctctccctgctgatcgtgtccgactaatctcccaaacctcaatcccttctacaaaacaacaactcctttccttcctaggcatagttagatactttcgcctttagatacctagttttaccatcctaacaaaaccattatataaactcacaaaaagaaacctagctaaccccatagatcctaaatcctttccccactcctctttccattccttgaagacagctttagagactgcccccaccctagctctccctgactcatcccaacccttttcattacacacagctgaagtgcaaggctgtgcagtcagaattcttacactaggaccaagatcatgtcctgtagcctttgtccaaacaacttgaccttactgttttaggctggccatcatgtctccatgcagcagctgctgccgccttaatactttcagaggctctaaaaatcacaaactatactcaactcactctctacatttctcataacttccaaaatctattttcttcctcacacctgacacatatactttctgctccccagctccttcagctatactcactctttgttaagtctcccacaattaccattgttcctggcccagacttcagtccagcctcccacattattccagataccacacctgaccctcatgactgcatctctctgatccacctgacgttcaccccatttccccatatttcctcctttcctgttcctcaccctgatcacacttagtttattgatggcggttccaccaggactaatcgccacacaccagcaaaggcaggctatgctacagtacaagccactagcccacctcttaaaacctctcatttcctttccatcgtagaaatctatcctcaaagaaataacttctcagtgttccatctgctattctactacttctgaaggattattcaggccccctcccttccctaaacatcaagctcaaagatttgcccctgcccaaggctggcaaatttgctattctactacttctcaatgattattcaggccccctcccttccctacacatcaagctcaaagatttgcccccgcccaggactggcaaattagctttactcaacataccctgagtcagataactaaaatacctcttagtctaagtagacactttcattagataagtagaggcctttcctacaaggtctgagaagaccaccacagtcatttcttcccttctgtcagacacaattcctcagtttagccttcccacctctctacagtctgataacagaccagcctttattagtcaaatcagccaagcactttttcaggctcttagtattcagtgaaacctttatatccctttacagtcctcagtcttcaggaaaagtagaatggactaaaagtcttttaaaaacacacctcaccaagctcagccaccaacttaaaaaagactagacaatacttataccactttcccttctcagaattcaggcctgtcctcagaatgctacgaagtacagcccatttaagctcctgtatagatgctcctttttattaggccccagtctcatcccaaataccagacaaacttagactgtgccccaaaaaacttgtcatcccttctatcttctatctagtcatactcctattcaccgttctcaactactcatacatgccctgctcttgtttacattgccggtttacactgtttctccaagccattacagctgatatctcctggtgctatccccaaactgccactcttaactcttaaagtaaataaataatctttcctggcaaggctatgctgaacctctttaagcactctctaattagatgtcctaaattctcccaattcttagtcctttaatacctgtatttctccttctcttattccgttgagtttttcaatccatacaaaaccgtatccaggccatcaccaataattctacatgacaaatgtttcttctaacaaccccacaatatcaccccttaccacaaaatcttccttcagcttaa

SEQ ID NO: 25 - DNA, 6340 bp, Homo sapiens
gtggggaaaagcaagagagatcagattgttactgtgtctgtgtagaaagaagtagacataggagactccattttgttatgtactaggagaaattcttctgccttgagattctgttaatctatgaccttacccccaaccccgtgctctctgaaacatgtgctgtgtcaactcagagttgaatggattaagggcggtgcaagatgtgctttgttaaacagatgcttgaaggcagcatgctccttaagagtcatcaccactccctaatctcaagtgcccagggacacaaacactgcggaaggccgcagggacctctgcctaggaaagccaggtattgtccaaggtttctccccatgtgatagtctgaaatatggcctcgtgggaagggaaagacctgaccgtcccccagcccaacacccgtaaagggtctgtgctgaggaggattagtataagaggaaggaatgcctcttgcagttgagacaagaggaaggcatctgtctcctgcctgtccctgggcaatgcaatgtctcggtataaaacccaattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctcttcgagaaacacccacaaatgatcaataaatactaagggaactcagaggctggggggatcctccatatgctgaacgctggttccccgggtccccttatttctttctctatattttgtctctgtgtctttttctttcctaagtctctcgttccaccttacgagaaacacccacagttgtggaggggcaacccacccctaaaattagaagtaaatatgcctcttatctcagctttattaaaattcttttaaaaagagggggagttaaagtatctacaaaaaatctaatcaagctatttcaaataatagaacaattttgcccatagtttccagaacaaggaactttagatctaaaagattaaaaaagaattagtaaggaactaaaacaagcaggtaggaaaagtaatatcattccacttacagtatggaatgattaggccattattaaagcagctttagaaccatttcaaacagaagaagatagcgtttcagtttctgatgcccctagaagctgtttaatagattgtaatgaaaagacaaagaaaaaatcccagaaagaaacgggaagtttacattgcgaatatgtagcagagccagtaatggctcagtcaacgcaaaatgttgactataatcaattacaggaggtgatatatcctgaaacgttaaaattagaaggaaaaggtcccgaattagtgaggccaccagagtctaaaccacgaaggccaagtcctcttccagcaagtcaggtgcctgtaacattacaacctcaaacgcaggttaaagaaaataagacccaaccgccagtagcttatcaatactagccgccggctgaacttcagtatcggccacccccagaaagtcagtatggatatccaagaatgcccccagcaccacagggcagggcgccataccctcagccgcccactaggagacttaatcctacggcaccacctagtagacaaggtagtgaattacatgaaattattgataaatcaagaaaggaaggagatactgaggcatggcaattcccagtaatgttagaaccgatgccacctggagaaggagcccaagagggagagcctctcacagttgaggccagatacaagtctttttcgataaaaatgctaaaagatatgaaagaaggagtaaaacagtatggacccaactccccttatatgaggacattattagattccattgctcatggacatagactcattccttatgattaggagattctggcaaaatcgtctctctcaccctctcaatttttacaatttaagacttagtagattgatgaggtacaagaacgggtccgaagaaataaggctgccaatcctccagttaacatagatgcagatcaactattaagaacaggtcaaaattagagtactattagtcaacaagcattaatgcaaaatgaggccattgagcaagttagaactatctgccttagagcctaagaaaaaatccaagacctaggaagcgcctgcccctcatttaatacagtaagacaaggttcgaaagagccctaccctgattttgtagcaaggctccaagatgttgctcaaaagtcaattgccgatgaaaaagcccgtaaggtcatagtgaagttgatggcatatgaaaacgccaatcctgagtgtcaatcagccattaagccattaaaaggaaaagttcctgcaggatcagatgtaatctcagaatatgtaaaagcctgtgatggaatcggaggagctatgcataaagctatgcttatggctcaagcaataacaggagttgttttaggaggacaagttagaacatttggaagaaaatgttataattgtagtcaaattagtcacttaaaaaagaattgcccagtcttaaataaacagaatataactattcaagctactaccacaacaagtagagaaccacctgacttatgtccaagatgtaaaaaaagaaaacattaggctagtcaatgtcattctaaatttgataaaaataggcaagcattgtcaggaaacaagcaaagaggccagcctcaggccccacaacaaactaaggcattcccaattcagccatttgttcctcaaggttttcaaagacaacaacccccactgtcccaagtgtttcaaggaataagccagttaccacaatacaacaattgtcccccgccacaagcagcagtgtagcagtagatttatgtactatacaagcagtctctctgcttccaaaggagcccccacaaaaaatccccacaaaggtatatggcccactgcctgagaggactgtaggactaatcttaggaagatcaagtctaaatctaaaaggagttcaaattcatactggtgtagttgattcagactataaaggcgaaattcagttagttattagctcttcaattccttgaagtgccagtccaagagacaagattgctcaattattactcctgccatatattaaaggtggaaatagtgaaataaaaagaataggagggcttggaagcactgatccaacaagaaaggctgcatattaggcaagtcaagtctcaaagaacagacctgtgtgtaaggccattattcaaggaaaacagtttgaaaagttagtagacactaaagcagatgtctctatcattgctttaaatcagtggccaaaaaattggcctaaacaaaaggctgttacaagacttgtcggcataggcacagcctcagaagtgtatcaaagtactaagattttacattgcttaaggccagataatcaagaaagtactgttcagccaatgattacttcaattcctcttaatctgtgaagtcaagatttattataacaatgaggtggggaaatcaccatgcccactccattatatagccccacgagtcaaaaaatcatgaccaagataagatatataccaggaaaaggactaaagaaaaatgaagatggcattaaagttccagttgaggctaaaataaatcaagaaaaagaaggaataaggtatcctttttagaggcggccactgtggagcctcctaaacacataccattaacttagaaaacagaaaaaccggtgtgggtaaatcagtggccgctaccaaaacaaaaactagaggctttacatttattaacaaatgaacagttagaaaaaagtcatattgagccttcattctcaccttagaattctcctgtgtttgtaattcagaagaaatcaggcaaatggcatatgttaactgacttaaaggccgtaaacgccgtaattcaacccataaggcctctccaacccgagttgccctctccagccatgatcccaaaagattggcctttaattataattgatctaaaggattgcttttttaccatccctctggcggagcaggattgtgaaaaatttgcctttactataccagccataaataataaagaaccagccaccaagtttcagtagaaagtgttacctcaaggaatgcttaatagtccaactatttgtcagacttttgtaggtcaagctcttcaaccagttaaagacaagttttcagactgttatattattcattatattgatgatattttatgtgctacagaaacgaaagataaattaattgactgttatacatttctgcaagcagaggttgccaatgcaggactggcaatagcatctgataagatccaaacctctactccttttcattatttaaggatgcagatagaaaatagaaaaattaagccacaaaaaatagaaataagaaaagacacattaaaaacactaaataattttcaaaaattgctaggagatattaattagattcagccaactctaggcattcctacttatgccatgtcaaatttgttctctatcttaagaaaagactcagacttaaatagtaaaagaatgttaaccccaaaggcaacaaaagaaattaaattagtagaagaaaaaattctgtcagcgcaaataaatagaatagatcccttagccccactccaacttttgatttttgccactgcacattctccaacaggcatcattattcaaaatactgatcttgtgaagtagtccttccttcctcacagtacaattaagacttttacattgtacttggatcaaatagctacattaattggtcagacaagattacgaataataaaattatgtggaaatgacccagacaaaatacttgtccctttaaccaaagaacaagtttgacaagcctttatcaattctagtgcatggcagattagtcttgctaattttgtaggaattattgataatcattacccaaaaacaaagatcttccagttcttaaaattgactacttagattctacctaaaattaccagacgtgaacctttagaaaatgctctaacagtatttactgatagttccagcaatagaaaagcagcttacacaaggctgaaagaacgagtaatcaaaactccatatcaatcagctcaaagagcagagttagttgcagtcattacagtgttacaagattttgaccaacctatcaatattatatcagattctgcatatgtagtacaggctacaaaagatgttaagacagctctaattaaatatagcatggatgatcagttaaaccagctattcaatttattacaacaaactgtaaaaaaaggaaatttcccattttatgttactcatattcgagcacacactaatttaccaaggcctttgactaaagcaaatgaacaagctgacttactagtatcatctgcattcataaaagcacaagaacttcatgctttgactcatgtaaatgcagcaagattaaaaaacaaatttgatgtcacatggaaacaggcaaaagatattgtacaacattgcacccagtgtcaagtcttacacctgcccactcaagaggcagaagttaatcccagaggtctgcgtcctaatgcattatggcaaatggatgtcacgcatgtaccttcatttagaagattatcatatgttcatgtaacagttgatacttattcacatttcatataggcaacttgccaaacaggagaaagtacttcccatgttaaaaaacatttattgtcttgttttgctgtaatagaagttccagaaaaaatcaaaactgacaatgaaccaagatattgtagtaaagctttccaaaaattcttaagtcagtagaaaatttcacatacaacaagaattccttataattcccaaggacaagccatagttgaaagaactaatagaacactcaaaactcaattagttaaacaaaaagaagggggagacagtaaggagtgtaccactcctcagatgcaacttaatctagcactctatactttaaattttttaaacatttacagaaatcaggctactacttctgcagaacaacatcttactggtaaaaagaacagcccacatgaaggaaacctaatttagtagaaagataataaaaataagacataggaaataaggaaggtgataacgtgggggagaggttttgcttgtgtttcaccaggagaaaatcagcttcctgtttggatacccactagacatttgaagttctacaatgaacccgtcggagatgcaaagaaaagggcctccacggaggtagtaacacc

SEQ ID NO: 26 - DNA, 7808 bp, Homo sapiens
gagagacgggactagctggatttcctaggccaactaagcatccctaagcctagctgggaaggtgaccacatccaactttaaacatggggcttgcaacttagctcacacccaaccaatcagagagctcactaaagtgctaattaggcaaaaacaggaggtagagaaatagccaatcatctatcccctgagagcccagcgggagggacaaggattgcgatataaacccaggccttccagcaggcaatggcaaccccctttgggtcccctccctttatatgggagctctgttttcaccctattaaatcttgcaactgcacttttctggtccatgtttgttacagcttgagctgagctttcgctcgccatccaccactgctgtttgccgttgtgccggacccgccactgacttctatccctccggatccggcagggtgtctgctgtgctcctgatccagcgaggcgcccattgctgctcccgatcaggctaaaggcttgccattgttcctgcacggctaagtgcctgggttcgtcctaatcgagctgaacactagttactgggttccatggttctcttctgtgatccatggcttctaatagaggtataacactcacctggcatggcccaggattccattccttgggatccgtgaggccaagaaccccaggtcagagaacacgaggcttgccaccatcttggaagcggcccaccaccatcttggaagctgctagccaccatcttggaagttctgtgaacaaggacccccggtaacattttggcgaccacgaagggacctccaaagtggtgagtaatattgacccttttgcttgctattctgtcctatccttccttacaattggaggaaaataccgggcacctgtcggtcagttaaaaacgattagcgtggctgccagacttaagactcacgtgtgaggctatctggggaagggctttctaacaactcccaacccttctgggttggggatgttggtctcgctggagccagcttccacttttaattttcttggggaagccaagggctgactagaggcagaaagctgtcctcccgaactcctggcagtagccggttgagatcacggcgcagccagaagtctctactcaacagtcgcccatgtgtgcgcccctacctttccttctgacccatacctcctgggtcccaaccacgactttcttgaaagtgtaaccccaaaattctccttacctctgaatctactcctctgatccctgcctcctaggtactaatggttcagactttcatttcctctagcaagttgtatctccaaagggatctaaggaagctctatgctgtgtccttaggcacctaggctataacccagggagttttatccctggagtccctcctgatttaggtatacagctctggacatgggcagttatgtaggacccattccccaccatccttgccagggccccaagtttgtaatggctaagagagggacagtgagagacagagagagagagatgaagagagatagagagacggagagagagggggatggagaaagagatagagcgagtcaaagagaaaaaaaaaagacaaatagtagaaaaaaagtgtgccctattcctttaaaagccagggtaaatttaaaacctgtaattgataattgaaggtcttctccatgaccctataacactccaatgccactttgttgtgagtgtaaataagggcgtagcccaaaagcactgaggccactgacaacctatggctttcctatcaaaaatccttaacccagtaacccttggataggccgaatgcattcattcggtagcggcaactgctttgctaaaagtagaaaagtaacttttagaggaaacctcgttgtgagcacacctcaccagttcagaattattctaagtcaaaaaaaaaaaaaaaaaaaaagcaaaaaggtagcttactaactcaaaaagcttaaagtatagggctattatattagaaaagggtaatgtaactccaaccactgataattcccttaacccagcagatttcctaacaggggttttaaatcttaattaccatacaaaggtccgaccagaactaggaggaactcccttcaggacaggacgacagatggttcctcccaggtgattgaggaaaaaaccacaatgggtattcagtaattgatacagagactcatgtggaagcagaattagaaaaattgcctaataattggtctcctcaaatgtacgagctgtttgcactcagccaagccttaaagtacttacagaatcaaaagactatttcaatcctgactcaaaagtttcgctacaccctctctgaaatgaatttgcataagaactattgtttatgggaatgcatcttgatggggcagctgggttgttatgaaatactcgggaacccagcccagctctaggactcacccctgagctcaaaggcaatgttgggtatgctggtaaaggaccactagaatccagcagcccgaacccctttctttgtggtcaagagaggcgggaaaacaggtgcaggactgctacatcggtgagtgtaactaatccgataaacagaggtccatgggtggttatgcaccctggaaaagaataagcattaggcccttagaggacgctctaggactaatgctcatcggaaaatgactaggggtgttggcatccctatattattttttcagatgggaaacgttccccccaacaccaaggcaaaaacgcccctgagatgtattctggagaattaggaccaatttgaccctcagacgctaagaaagatactcttctgcagtaccacctggccacgatatcctcttcaatggggagaaatctggcctcctgagggaagtataaattatgaccccatcttacagctagacctcttctgtagaaaggagggcaaatggagtgaagtgccatatgtacaaactttcttttcattaagagacaactcgcaattatgtaaaaagtgtggtttatgccctacaggaagccctcaagagtctacctccctatcccagcgtccccccgactccttctccaactaataaggaccccccttttacccaaatggtccataggagatagacaaagggataaacaatgagccaaacagtgccaatattccctgattatgccccctccaagcagtgggaggagaattcagcccagccagagtgcatgtacctttttctctctcagacttaaagcaagttaaaatagacctaggtaaattctcagctaaccctgatggctatattgatgttttacaagggttaggacaatcctttgatctgacatggagagatataatgttactgttaaatcagacactaaccccaaatgagagaagtgccgccacaactgcagcccgagagtttggctatctctggtatctcagtcaggtcaattataggatgacaacagaggaaagcgaacaattccccaaaggccagcaggcagttccctgtgtagaccttcactgggacacagaatcagaacatggagattggtgccacagacatttgctaacttgcatgctaggactagggaaaactaggaagaagcctgtgaattattcagtgatgtccactataacaaaggaaaaggaagaaaatcctactgcctttctggagagactaaggggggcattgaggaagcatacctctctgtcacctgactattgaaggccaactaatcttaaaggataagtttatcactcagtcagctgcagacattagaaaaaaacttcaaaagtccgccttaggcctggagcaaaactgagaaaccctattgaacttggcaaccttggtttttttataatagagatcaggaggagcaggcggatcgggacaaacgggattaaaaaaaaggccaccactttagtcatgaacctcaggcaagtggattttggaggctctggaaaagggaaaagctgggaaaatcaaacctaataggacttgcttccagtgtggtctacaaggacactttaaaaaagattgtccaagtagaaataagccgcccccttgtccatgccccttatgtcaagggaatcactggaaggcccattgccccaggggacgaagatcttctgagtcagaagccactaaccagatgatccagcagcaggactgagggtgcccggggcaagcgccagcgcatgccatcaccctcacagagcccccggtttgcttgaccattgagggccagggaggttaactgtctcctggacactggcatggccttctcagtcttactatcctgtcctggacaactgtcctccagatctgtcactatccgaggggtcctaggacagccagtcactagatacttctcccagccactaagttgtgactggggaactttactcttttcacatgcttttctaattatgcctgaaagccccactcccttgttagggagagacattctagcagaagtgggggccattatacatctgaacataggagaaggaacacccgtttgttttcccctgcttgaggaaggaattaatcctaaagtctaggcaacagaaggacaatatagatgagcaaaaaatgcccgtcctgttcaagttaaactaaaggattctgcctcctttccctaccaaaggcagtacccccttagacccaaggcccagcaaggactccaaaagattgttaaggacctaaaagcccaaggcctagtaaaaccatgcaatagcccctgcaatactccagctttaggagtacagaaacccaacagacagtggaggttagtgcaagatctcaggattattaatgaggctgtttttcctctatacccagctgtatctagcccttatactctgctttccctaataccagaggaagcagagtagtttacagtcctggaccttaaggatgcctttttctgcatccctgtacatcctgattctcaattcttgtttgtctttgaagatcctttgaacccaatgtctcaattcacctggactgttttaccccaggggttcagggatagcccccatctatttggccaggcattagcccaagacttgagccaattctcatacctggacagtcttgtccttcggtatggggatgatttaattttagccacccgttcagaaaccttgtgccatcaagccacccaagcgctcttaaatttcctcactccgtgtggctacaaggtttccaaaccaaaggctcagctctgctcacagcaggttaaatacttagggttaaaattatccaaaggcaccagggccctctgtgaggaatgtatccaacctgtactggcttatcctcatcccaaaaccctaaagcaactaagaaggtccttggcataacaggtttctgctgaatgtggatttccaggtacaacgaaatagccagaccattatatacactaattaaagaaactcagaaagccaatacccatttagtaagatggatacctgaagcagaagcagctttccagggcctaaaggaggccctaacccaagccccagtgttaagcttgccaacgcggcaagacttttctttatatgtcacagaaaaaataggaatagctctaggagtccttacacaggtccaaaggatgagcttgccacctgagtaaggaaattgatgcagtggcaaagggttggcctcattgtttacgggtagtggcggcagtagcagtcttagtatctgaagcagttaaaataatacagggaagggatattactgtgtggacgtctcatgatgtgaatggcgtactcactgctaaaggagacttgtggctgtcagacaaccatttacttaaatatcaggctctattatttgaagggccagtgctgcgactgcgcacttgtgcacctcttaatccagtcacatttcttccagacaatgaagaaaagatagaacataactgccaacaagtaattgctcaaacctgtgcagctagagggaaccttttagaggttccctcgactgatcccatcctcaacttgtatactgatgaaagttcctttgtaaaaaaaaaaaagcacttcaaaaagtaaggtatgcagtggtcagtgataatagaatacttaaaagtaatcccctcactccaggaactagtgctcagctggcagaactaatagccctcaggcactaaaattaggagaaggaaaaagggtaaatatatatacagcctctaagtatgcttacctagtccaccatgcccatgcagcaatatagagagatagggaattcctaacttcctagggaacacctatcaaacatcaggaagccattaggagattattattggctgcacagaaacctaaagaggtgacagtcttacactgccagggtcatcagaaaggaaaggaaaatagaagaaaaccgccaagtggatattaaagtcaaaagagccgcaaggcaggaggctccattagaaatgcttatagaaggacccctagtatagggtaatcccctccaggaaaccaagccccagtactcagcaggaaaaatagaataaggaacctcacaaggacatactttcctcccctccagatggctagccaccaaagaaggaaaatatttttgcctgcagctaaccaatagaaattacttaaatcccttcaccaaaccttccacttaggcattgacagcacccatcagatggccgaattattatttactggaccaggccttttcaaaactatcaagcagatagtcagggcctgtacagtgtgccaaagaagtaatcccttgcactgcaggccatacatttcaatccctatatctttaacctccttgttaagtttgtctcttctggaatcaaagctgcaaaactacaaatcattcttcaaatggagccccagatgcagtctatgactaagatctaccgcggacccctggaccagcctgctagcccatgctccgatgtcaatgacatcgaaagcacccctcccgaggaaatctcaattgcaccacccctactacgccccaattcagccagaagcagttagagcagtcatcggccaacctccccagcagcacttgggttttcctgttgagacaggggactgagagacaggattagctggatttcctaggccgactaagaatccttaagcctagctgggaaggtgactgcatccacctttaaatatggggcttgtaacttagctcacacccaaccaatcagagagctcactaaaatgctaattaggcaaaaacaggaggtagagaaatagccaatctattgcctgagagcacagcgggagggacaaggatcgggatataaacccaggcatttgacaaccccctttgggtcccctccctttgtatgggagctctgttttcactctatttcactctattaaatcttgcaactgcactcttctggtccatgtttgttacagctcgagctgagctttcgctagccgtctaccactgctgtttgccgccatggcagacccactgctgagttctatccctccggatccgtcagggtgtccgctgtgctcctgatccagagaggcacccattgccactcctgattgggctaaaggcttgccattgttcctgcatggctaagtgcccgggttcattctaatccagctgaacactagtcactgggttccatggttctcttccgtgacccatggcttctaatagaggtataacacttgctgcgtagcccaagattccattccttggaatccatgaggccaagaaccccagatcagagaacacgaggcttgccaccatcttggaagcagcccaccatcctcttggaagcggcttgccaccatcttggaagctctgtgaacaaggatcccccggtaaca

SEQ ID NO: 27 - DNA, 967 bp, Homo sapiens
gtggggaaaagaaagagagatcggattgttactgtgtctgtgtagaaagaagtagacataggagtctccattttgttctgtactaagaaaaattcttctgccttgagatgctgttaatctatgaccttaccccaaccccgtgctctctgaaacatgtgctgtgtcaactcagggttaaatggattaagggctatgcaagatgtgctttgttaaacagatgcttgaagtcagcatgctctttaagagtcatcaccactccctaatctcaagtacccagggactcaaacactgcggaaggccgcagggacctctgcctaggaaagccaggtattgtccaaggtttctccccatatgatagtctgaaatatggccttgtgggaagggaaagacctgaccgtcccccagcccgacacccataaatggtctgtgctgaggaggattagtataagaggaaggaacacctctttgcagttgaaacaagaggaaggcatctgtctcctgcccgtccctgggcaatggaatgtctcagtgtaaaacccgattgtatgttccatctactgagataggggaaaaccaccttagggctggaggtgggacaggcgggcagcaatactgctctttaaggcattgagatgtttatgtgtatgcatatctaaagcacagcacttaattctttaccttgtctatgatgcagagaccttccctcacgtgtttatctgctgaccttctctccactattatcctatgaccctgccacatccccctctccgagaaacacccaagaatgatcaataaatactaagggaactcaagaggccagcgggatcctccgtatgctgaacgctggtcccctgggcccccttatttctttctccatactttgtctctgtgtctttttcttttccaagtctctcattccacctaatgagaaacacccacaggtgtggaggggcaacgcaccccttca

SEQ ID NO: 28 - DNA, 6304 bp, Homo sapiens
gtcaggcctctgagcccaagctaagccatcatatcccctgtgacctgcacgtacacatctagatggccggttcctgccttaactgatgacattccgccacaaaaaaagtgaaaatggcctgttcctgccttaactgatgacattatcttgtgaaattccttctcctggctcatcctggcttaaaagctctcctactgagcaccttgtgaccccccactcctgcctgccagagaacaacccctctttgacggtgattttcctttacctacgcaaatcttataaaacggccctacccctatctcccttcgctgactctcttttcggactcagcccacctgcacccaggtgattaaagagctttattgctcacacaaagcctgtttggtggtctcttcatatggacgagagtgaaatctggtgccgtgacttggatcaggggacctcccttgggagatcaatcccctgtcctgctttttgttccatgagaaagattcacctacgacctctggtcctcagaccaaccagcccaaggaacatctcaccaattttaaatctggtaagcggcctctttttactctcttctccaacctctctcactatccctcaacctctttctcctttcaatcttggtgccacacttcaatctctcccttctcttaatttcagttccttttcttttctagtagagacaaaggagacgcgttttatccattgacccaaaactccggtgctggtcactgacttgggaagacagtcttcccttggtgtttaatcacgtggggatggctgcctgattattcacccatgtttcagaggtgtctgaccatgcaaggacgcctgccttggtccttcacccttagcggcaagtaccgcttttctggagggcaagaaacccccaaccccttctctccgtgtctctaccccttctccgcttttctgggaggcaagaatcccccgacccttctctccatgtctaccccttctccacttttctgcggggcaagaaacccccagccccttctccttcacccttagcagcaagtaccacttttctagagggcaagaatcccccaacccttctctccgtgtctctaccccttctccacttttctggggcgcaagaaccccccaccccttctctctgtgtctctactctctcttttctctgggcttgcctccttcactatgggcaagctcccgccctccattcccttcttctcccttagcctgtgttcttaaaaacctaaaacctcttcaactcacacctgacctaaaacctaaatgccttttcttctgcaatcctgcttgaccccaatacaaacttgacagtagttccaaatagccaaaaaatggcagtttcaatttttccatcctacaagacctaaataattcttgtcacaaaataggcaaacggtctgaggtgcctgacgtccaggcattcttttacacatcagtccctccctagtctctgttcccagtgcaactcatcccaagtcttccttctttccctcccgcctgtcccctcagtcccaaccccacgcgtcgctgagtcttcctaatctttcttttctacagacccatctgacttctcccctcctcaccaggccgagctaggtcacaattcttcctcagcctccactcctccaccctataatcattttatcacctcccctcctcacacccggtccggcttagtttcgttccgcgactagccctcccccacctgcccagcaatttcctcttaaaaaggtggctggagctaaaggcatagtcaaggttaatgctcctttttctttatcccaaatcagatagtgtttaggcttttttcatcaaataaaaaacgcagcccagttcatggctcatttggcagcaaccctgggatgctttacagccctagaccctaaaaggtcaaaaggccgtcttacactcaatatacattttattacccaatccgctccggacattaaataaaacttcaaaaattaaattccagccctcaaaccccacaacaggacttaattaacctcgccttcaaggtgtacaataataaagtagaggcagccaagtagcaatgtatttctgagttgcaattccttgcctccactgtgagacaaaccccagccatatctccagcacacaagaactccaaacgcctgaactgcagctgctggggttactctagaacctcctcccccaggagcttgctacaagtgccagaaatctggccactgggccaaggaatgcctacagcccaggattcctcctaagctgtgtcccatctgtgcaggaccccactgaaaattggactgttcaactgacctggcagccactttcagagcccctggaactctggcccaaggctctctgactgactccttcccagatcttctcagcttagcggctgaagactgacactgcccaattgcctcggaagcctacgggaccatcacagatgctctgggtaactctcacagtggagagtaagtctgtccccctcttaatcaatacggagcctacccattccacattaccttcttttcaagggcctgtttcccttgcccccataaccgttggaggtattgacggccaggcttctaaacctcttaaaactccccaactctggtgctaatttagacagtactcttttaagcactcctttttagttatccccacccgcccagttcacttattaggccgagacacttaaactaaattatctgcttccctgcctattcctgggctacagccacacctcaatgccgccttttcccccagttcagagcctccttcacatcctccctttgtatctccccatcttaacccacaagtataggacacctctactccctccttagcaactgatcatgcaccccttaccatcccattaaaacctaatcactcttaccccgctcaatgccaatatcccatcccatggcatgctttaaaaggattaaagtctgttatcactcgcctgctacagcatggccttttaaagcctataaactctccttacaattccccaattttacctgtcctaaaaccagacaaggtttacaggttagttcaggatctgcgccttatcaaccaaattgttttgcctatccaccccatggtgccaaacccatacactctcctatcctcaatacctccctccacaacccattattctgttctggatctcaaacatgctttctttactattcctttgcacccttcatcccagcctctcttcgctttcacttggactgaccctgacacccatcaggttcagcaaattacctgggctatactgccgcaaagcttcacagacagcccccattacttcagtcaagcccaaatttcttcctcatctgttacctatctcggcataattctcataaagacacgtgctctccctgctgatcgtgtccggctaatctcccaaaccccaatcccttctacaaaacaacaactcctttccttcctaggcatggttagtgtggtcagaattcttacacaagagccgggaccacaccctgtagcctttctgtccaacttgaccttactgttttagcctagccctcatgtctgcatgcagcggctgccgctgctttaatacttttagaggccctaaaaatcacaaactatgctcaattcactctctacagttctcataacttccaaaatctattttctttctcccacctgatgcatatactttctgctccctggctccttcagctgtactcacttcttgttgagtctcccacaattaccattgttcctggcccagacttcaatccagcctcccacagtattccagataccacacctgacccccatgactgtatctctctgatccacctgacattcaccccatttccccatatttcctttcctgttcctcaccctgaacacatttggtctattgatggcagtttcaccaggcctaatcgccacacaccaccaaaggcaggctatgctatagtacaagccaccagcccacctcttagaacctctcatttcctttccattgtggaaatctatcctcaaggaaataacttctcagtgttccatctgctattctactactcctcagggattattcagtccccctcccttccctacacatcaagctcgagaatttgcccccgcccaggactggcaactcttaactccctcttagagtggatagatgatctctgctggcaggggaccctccaatacttccaccctgatgaagttctattgtttagttttatactcactcttattatcattcccattcttatgccaccctctacctctccccagctatctccaccatactatcaactttactcattctctcctagccgtttctaatccctccttagcgaacaaccgctggctttgcatttccctttcttccagtgcctacacagctgtccccgccttacatgcagactaggcaacatctcctgtctccctatacctccgaacttcctttaacagccctcacctttaccctcctgaagaactcatttactttctagacaggtccagcaagacctccccagacatttgacatcagcaagctgccaccctcctccgcacttacttaaaacacctttctccttatatcaactctactccccacatatttggacccctcacaacacaaactactattcctgtggctgctcctttatgtatctctcgtcaaagacccattggaattcccctgggtaacctttcaccttctcgatgttcctttactcttcatctccaaagccctcttcttgtttacttatacccagccccgaaaataacagtgaaaggttggtcgtagacactcgacgttttctcacacaccatgaaaatcgaacctccccctctacacagttacctcatcagttcccgttacaacctctgacggctgccgccctagctggatccctaggagtctaggtacaagacacctttttcagcactccttctcatctttttagtttgcatctccagttttgcctcgcacaaggtctcttcttcctctgtggatcctctacctacatgtgtctacctgctaattgggcaggtacatgcacactagttttccttactcccaaaattcaatttgcaaataggaccgaagagctccctgttcccctctgacaccgacacgacaaaaaagagttattccactaattcccgtgcttgtcagtttaagactttctgcctccactattgctctcagtattggaatagcaggcatttcaacctctgtcacgaccttccatagcctctctaatgacttctctgctagcatcacagacatcccacaaactttatcagtcctccaggcccaagttgactctttagctgcagttgtcctccaaaaccgccgaggccttgacttactcactgctgaaaaaggaggactccgtatattcttaaatgaagagtgttgtttttacctaaatcaatctggcctagtgtatgacaacataaaaaactcaaggatagagcccaaaaacttgccaaccaagcaagtaattacgctgcaccccctggggcactctctaattagatgtcctaggtcctcccaattcttagtcctttaatacctgtttttctccttctcttattctgtttagtttttcaattcatacaaaaccatatccaggccatcaccaataattctacacgacaaaatgtttcttctaacaaccccacaatatcaccccttaccataaaatcttccttcagcttaatctctcccactctaggttcccatgctgcccctaatcccgcttgaagcagccctgagaaacatcgcccattatctctccataccacccccaaaaatttcgctgtcccaaaactttaccactatttcattttatttttcttattaatataagaagacaggaatgtcaggcctctgagcccaagctaagccatcatatcccctgtgaggtgcacgtacacatccagatggctggttcctgccttaactgatgacattccaccacaaaagaagtgaaaatggcctgttcctgccttaactgatgacattatcttgtgaaattccttctcctggctcatcctggctcaaaagctcccctactgagcaccttgtgacccccactcctgcccactagagaacaacccccctttgactgtaattttcctttacctacccaaatcttataaaacggccctaccccatctcccttcgctgactctcttttcggactcagcctacctgcatccaggtgattaaaaagctttattgctcacacaaagcctgtttggtggtctcttcacacggacgagagtgaaa

SEQ ID NO: 29 - DNA, 4636 bp, Homo sapiens
gtcaggcctctgagcccaggccaggccatcgcatcccctgtgactggcacgtatacatccagatggcctgaagtaactgaagatccacaaaagaagtaaaaacagccttaactgatgacattccaccattgtgatttgttcctgccccaccctaactgatcaatgtactttgtagtctcccccacccttaagaaggttctttgtaattctccccacccttgagaatgtactttgtgagatccacccctgcccaccagagagcaaccccctttgactgtaattttccattaccttcccaaatcctataaaacggccccacccgtatctcccttcgctgactctcttttcggactcagccggcctgcacccaggtgaaataaacagccatgcttctcacacaaagcctgtttggtggtctcttcacacagacgcgcatgaaatttggtgccgtgactcggatcgggggacctcccttgggaggtcaatcccctgtcctcctgctctttgctccgtgagaaagatccacctaccacctcaggtcctcagtccaaccagcccaggaaacatcccaccaatttcaaatccggtaagcggcctctttttactctcttctccaacctccctcactatccctcaacctctttctcctttcaatcttggcgccacatttcaatctctcccttctcttaatttcaattcctttcattttctggtagagacaaaagagacatgttttatccgtgaacccaaaactccggcgccggtcacggactgggaaggcagccttcccttggtgtttaatcattgcagggacgcctctctgattatacactcacgtttcaagggtgtcagaccacgcagggacgcccgccttggtccttcacccttagtggcaagtcccgctttcctggggcaggggcaagtacccctcaaccccttctccttcaccctcagtggcaagtcccgctttcctagggggcaagaaacccccaatcgcttatttccgcaccccaacctcttatatctctgcaccccaatcccttatttccacaccctgacctctttgtgccccaatcccttacttccgtgccccaaccccttctctgcttttctggagggcgagaaccccccaccccttctccgtgtctctactcttttttctgggcttgcctccttcactatgggtaagcttccaccttccattcctcctccttctcctttagcctgtgttctcaaaaacttaaaacctcttcaactcacacctgacctaaaacctaaatgccttattttcttctgcaatgccgcttgactccaatacaagctcgacagtagttccaaatagccggaaaacggcactttcaatttttccatcctacaagatctaaataattcttgtcgtaaaatgggcaaatggtctgaggtgcctgaagtccatcagtcccttcctactctctgtgcccagtgcaactcgtcccaaatcttccttctttccctcccacctgtcccctcagtcccaaccccaagcgtcgctgagtctttctcatcttccttttctacagacccatctgacctctcccctcctcgccagcccaagctaagtcccaattcttcctcagcctctgctcctgcatcctgtcatttttttatcgcctcccctcctcacacctggtccggcttacagtttcgttccgtgactagccctccccctcctgcccagcaatttactcttaaaaaggtggctggagccaaaggcatagtcgaggttaatgctcctttttctttatcccaaatcagaagcgtttaggctctttttcatcaaatataaaaacccagcccagttcatgacttgtttggcagtaaccctgagacactttacagccctagaccctaaaaagtcaaaaggccgtcttattctcaaaatatattttattacccaatctgctcccgacattaaataaaactccaaaaattaaattccggccctcaaaccccacaacaggacttaatgaacctcgccttcaaggtgtacaataatagaaaaaagttgcaattccttgcctccactgtgagacaaaccccagccacatctccagcacacaagaacttccaaatgcctgaaccgcagcggccaggcgttcctccagaacctcctcccccaggagcttgctacacgtgccggaaatctggccactgggccaaggaatgcccgctgcccgggattcctcctaagccgcgtcccatctgtgtgggaccccactgaaaatcggactgttcaactcacctggcagccactcccagagcccctggaactctggcccaaggctctctgactgactccttcccagatcttctcggcttagcggctgaagactgacgctgcccgatcgcctcggaagccccgtagaccatcacggacgccgagcttcgggtaactctcacagtggaaggtaagtccgtccccttcttaatcaatacggaggctacccactccacattatcttcttttcaagggcctgtttcccttgcctccataactgttgtgggtattgacggccaggcttcaaaacccctgaaaactcccccactctggtgccaacttagacaacactcttttatgcactcttttttagttatccccacctgcccagttcccttattaggccgagatactttaaccaaattatctgcttccctgactattcctggactacagccgcatctcattgccgcccttctccccagcccaaagcttccttcacgtcttcctctcgtatccccccaccttaagccacaagtatgggacatctctactccttccctggcaactgatcacatgcccattaccatcccattaaaacctaatcacccttaccccgctcaacgccaatatcccatcccacagcatgctttaaaaggattaaagcctgttatcactcgcctgctatagcatgggcttctaaaacctataaactctccttacaattcccccattttacctgtccgaaaaccggataagtcttacagattagttcaggatctgcgtcttatcaaccaaattgttttgccatccaccctgtggtgcccaacccgtaccctcttttgtcctcaatccgttcctccacaactcactattctgttctccatcttaaagatgcttttttcactgttcccctgcacccctcgtcccagcctctctttgctttcacttagactgaccctgacacccattaggctcagcaaattaccaaggctgtactgctgcaaagcttcacagacagcccccattacttcaatcaagcacaaatttcttcctcatctgttacctatctcggcataattctcaaaaacacacgtgctttccctgccaatcgtgtccgactgacctctcaaaccccagcacctacaaaacaacaactcctttccttcctaggcatggttagcgtggtcggaattcttacacaagagccaggaccacaccctgtagcctttctgtccaaacaacttgaccttactgttttaacctagccctcatgtctgcgtgcagcggctgctgctgctttaatacttttagaggccctcaaaatcacaaactttatcagtcctccaggcccaagttgactctttagctgcagttgtcctccaaaaccaccgaggccttgactgacttactgctgaaaaaggaggactctgcatattcttaaatgaggagtgttgtttttacctaaatcaatctggcctggtgtatgacaacataaaaaaactcaaggatagagcccaaaaacttgccaaccaagaaagtaattacgctgaacccccttgggcactctctaattggatgtcctgggccctcccaattcttagtcctttaatacccatttttctcctccttttcttcagaccttctatcttccgtttagcttctcagttcattgaaaaccgtatccaggccatcaccaatcattctatacgacaaatgtttcttctaacatccccacaatatcaccccttaccacaagacctcccttcagcttaatctctcccactctaggttcccacgccgcccctaatcccgctcgaagcagccctgagaaacatcgcccgttctctctccataccaccccccaaaaattttcgccgctgcaacacttcaacactattttgttttatttgtcttattaatataagaaggcaggaatgtcaggcctctgagcccaggccaggtcatcgcatcccctgtgacttgcacgtatacatccagatggcctgaagtaactgcagatccacaaaagaagtaaaaacagccttaactggtgatattccaccattgtgatttgttcctgccccaccctaactgatcaatgtactttgtagtctcccccacccttaagaaggttctttgtaattctccccactcttgagaatgtactttgtgagatccacccctgcccaccagagaacaaccccctttgactgtaattttccattaccttcccaaatcctataaaacggccccacccctatctcccttcgctgactctcttttcggactcagccggcctgcacccaggtgaaataaacagccatgctgctcacacaaagcctgtttggtggtctcttcacatggacacgcatgaaa

SEQ ID NO: 30 - DNA, 956 bp, Homo sapiens
cctccaaaatcgctgaggtctcgacttactcactgctaaaaaaaaaaaaggggggggggactctgtatatttttaaatgaagagtgctgtttttacctaaatcaatctggcctggtatatgacaacatttaaaaaaaaaaaaaaaacaacaactcaaagatagagcctaaaaacttgccgaccaagcaagtaattacgctgaacccccttgggcccccttggatactctctaattagatgtcctgggtcctcccaattcttagtcttttaatatctgtttttcctcttctcatatttggaccttatgtcttccgtttagtttctcaattcatccaaaaccgtatccaggccatcatcaatgattctatatgacaaatgctccttctaacaaccccacgatatcaccccttaccacaaaatcttccttcagcttaatctctcccactctaggttcccacgccgccccaatcctgctcaaagcagccctgagaaacatcgcccattatctctccataccaccccccaaaatttttgctgccccaacacttcaacactattttgttttatttttcttattaatataagaagacaggaatgtcaggcctctgagcccaagctcagccatcatatcccctgtgacccgcacgtatacatccagatggcctgaagtaactgaagaatcacaacagaagtgaaaatggtttgttcctgccttaactgatgacattaccttgtgaaattccttctcctggctcatcctggctcaaaagctcccctactgagcaccttgtgacccccgcccctgcccgccagtgaacaaccccctttgactaattttcctttacctatccaaatcctataaaatggccccacccctatctcctttcgctaactctcttttcagactcagcccacctgcacccaggtgaaataaacagcctttttgcccaaaaaaa

SEQ ID NO: 31 - DNA, 6501 bp, Homo sapiens
gtggggaaaagcaagagagatcaaattgttactgtgtctgtgtagaaagaagtagacataggagactccattttgttatgtgctaagaaaaattcttctgccttgagattctgttaatctatgaccttacccccaaccccgtgctctctgaaacgtgtgctgtgtcaactcagggttgaatggattaagggcggtgcaggatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacctgtaaagggtctgtgctgaggaggattagtaaaagaggaaggaatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcattgagatgtttatgtgtatgcatatccaaaagcacagcacttaatcctttacattgtctatgatgccaagacctttgttcacgtgtttgtctgctgaccctctccctacaattgtcttgtgaccctgacacatccccctctttgagaaacacccacagatgatcaataaatactaagggaactcagaggctggcgggatcctccatatgctgaacgctggttccccgggtccccttatttctttctctatactttgtctctgtgtctttttcttttccaaatctctcgtcccaccttacgagaaacacccacaggtgtgtaggggcaacccacccctacatctggtgcccaacgtggaggcttttctctagggtgaaggtacgctcgagcgtggtcattgaggacaagtcgacgagagatcccgagtacatctacagtcagccttacggtaagcttgcgcgctcggaagaagctagggtgataatggggcaaactaaaagtaaaattaaaagtaaatatgcctcttatctcagctttattaaaattcttttaaaaagagggggagttaaagtatctacaaaaaatctaatcaagctatttcaaataatagaacaattttgcccatggtttccagaacaaggaactttagatctaaaagattggaaaagaattggtaaggaactaaaacaagcaggtaggaagggtaatatcattccacttacagtatggaatgattgggccattattaaagcagctttagaaccatttcaaacagaagaagatagcatttcagtttctgatgcccctggaagctgtttaatagattgtaatgaaaacacaaggaaaaaatcccagaaagaaaccgaaagtttacattgcgaatatgtagcagagccggtaatggctcagtcaacgcaaaatgttgactataatcaattacaggaggtgatatatcctgaaacgttaaaattagaaggaaaaggtccagaattaatggggccatcagagtctaaaccacgaggcacaagtcctcttccagcaggtcaggtgcccgtaagattacaacctcaaaagcaggttaaagaaaataagacccaaccgccagtagcctatcaatactggccgccggctgaacttcagtatcggccacccccagaaagtcagtatggatatccaggaatgcccccagcaccacagggcagggcgccataccatcagccgcccactaggagacttaatcctatggcaccacctagtagacagggtagtgaattacatgaaattattgataaatcaagaaaggaaggagatactgaggcatggcaattcccagtaacgttagaaccgatgccacctggagaaggagcccaagagggagagcctcccacagttgaggccagatacaagtctttttcgataaaaatgctaaaagatatgaaagagggagtaaaacagtatggacccaactccccttatatgaggacattattagattccattgcttatggacatagactcattccttatgattgggagattctggcaaaatcgtctctctcaccctctcaatttttacaatttaagacttggtggattgatggggtacaagaacaggtccgaagaaatagggctgccaatcctccagttaacatagatgcagatcaactattaggaataggtcaaaattggagtactattagtcaacaagcattaatgcaaaatgaggccattgagcaagttagagctatctgccttagagcctgggaaaaaatccaagacccaggaagtacctgcccctcatttaatacagtaagacaaggttcaaaagagccctaccctgattttgtggcaaggctccaagatgttgctcaaaagtcaattgccgatgaaaaagccggtaaggtcatagtggagttgatggcatatgaaaacgccaatcctgagtgtcaatcagccattaagccattaaaaggaaaggttcctgcaggatcagatgtaatctcagaatatgtaaaagcctgtgatggaatcggaggagctatgcataaagctatgcttatggctcaagcaataacaggagttgttttaggaggacaagttagaacatttggaggaaaatgttataattgtggtcaaattggtcacttaaaaaagaattgcccagtcttaaacaaacagaatataactattcaagcaactacaacaggtagagagccacctgacttatgtccaagatgtaaaaaaggaaaacattgggctagtcaatgtcgttctaaatttgataaaaatgggcaaccattgtcgggaaacgagcaaaggggccagcctcaggccccacaacaaactggggcattcccaattcagccatttgttcctcagggttttcagggacaacaacccctactgtcccaagtgtttcagggaataagccagttaccacaatacaacaattgtccctcaccacaagcggcagtgcagcagtagatttatgtactatacaagcagtctctctgcttccaggggagcccccacaaaaaatccctacaggggtatatggcccactgcctgaggggactgtaggactaatcttgggaagatcaagtctaaatctaaaaggagttcaaattcatactagtgtggttgattcagactataaaggcgaaattcaattggttattagctcttcaattccttggagtgccagtccaagagacaggattgctcaattattactcctgccatatattaagggtggaaatagtgaaataaaaagaataggagggcttgtaagcactgatccaacaggaaaggctgcatattgggcaagtcaggtctcagagaacagacctgtgtgtaaggccattattcaaggaaaacagtttgaagggttggtagacactggagcagatgtctctatcattgctttaaatcagtggccaaaaaattggcctaaacaaaaggctgttacaggacttgtcggcataggcacagcctcagaagtgtatcaaagtatggagattttacattgcttagggccagataatcaagaaagtactgttcagccaatgattacttcaattcctcttaatctgtggggtcgagatttattacaacaatggggtgcggaaatcaccatgcccgctccattatatagccccacgagtcaaaaaatcatgaccaagatgggatatataccaggaaagggactagggaaaaatgaagatggcattaaagttccagttgaggctaaaataaatcaagaaagagaaggaatagggtatcctttttaggggcggtcactgtagagcctcctaaacccataccactaacttggaaaacagaaaaaccggtgtgggtaaatcagtggccgctaccaaaacaaaaactggaggctttacatttattagcaaatgaacagttagaaaagggtcacattgagccttcgttctcaccttggaattctcctgtgtttgtaattcagaagaaatcaggcaaatggcgtatgttaactgacttaagggctgtaaacgccgtaattcaacccatggggcctctccaacccgggttgccctctccggccatgatcccaaaagattggcctttaattataattgatctaaaggattgcttttttaccatccctctggcagagcaggattgtgaaaaatttgcctttactataccagccataaataataaagaaccagccaccaggtttcagtggaaagtgttacctcagggaatgcttaatagtccaactatttgtcagacttttgtaggtcgagctcttcaaccagtgagagaaaagttttcagactgttatattattcattatattgatgatattttatgtgctgcagaaacgaaagataaattaattgactgttatacatttctgcaagcagaggttgccaatgctggactggcaatagcatctgataagatccaaacctctactccttttcattatttagggatgcagatagaaaatagaaaaattaagccacaaaaaatagaaataagaaaagacacattaaaaacactaaatgattttcaaaaattactaggagatattaattggattcggccaactctaggcattcctacttatgccatgtcaaatttgttctctatcttaagaggagactcagacttaaatagtcaaagaatattaaccccagaggcaacaaaagaaattaaattagtggaagaaaaaattcagtcagcgcaaataaatagaatagatcccttagccccactccaactttttatttttgccactgcacattctccaacaggcatcattattcaaaatactgatcttgtggagtggtcattccttcctcacagtacagttaagacttttacattgtacttggatcaaatagctacattaatcggtcagacaagattacgaataacaaaattatgtggaaatgacccagacaaaatagttgtccctttaaccaaggaacaagttagacaagcctttatcaattctggtgcatggcagattggtcttgctaattttgtgggacttattgataatcattacccaaaaacaaagatcttccagttcttaaaattgactacttggattctacctaaaattaccagacgtgaacctttagaaaatgctctaacagtatttactgatggttccagcaatggaaaagcagcttacacagggccgaaagaacgagtaatcaaaactccatatcaatcggctcaaagagcagagttggttgcagtcattacagtgttacaagattttgaccaacctatcaatattatatcagattctgcatatgtagtacaggctacaagggatgttgagacagctctaattaaatatagcatggatgatcagttaaaccagctattcaatttattacaacaaactgtaagaaaaagaaatttcccattttatattactcatattcgagcacacactaatttaccagggcctttgactaaagcaaatgaacaagctgacttactggtatcatctgcactcataaaagcacaagaacttcatgctttgactcatgtaaatgcagcaggattaaaaaacaaatttgatgtcacatggaaacaggcaaaagatattgtacaacattgcacccagtgtcaagtcttacacctgcccactcaagaggcaggagttaatcccagaggtctgtgtcctaatgcattatggcaaatggatgtcacgcatgtaccttcatttggaagattatcatatgttcatgtaacagttgatacttattcacatttcatatgggcaacttgccaaacaggagaaagtacttcccatgttaaaaaacatttattgtcttgttttgctgtaatgggagttccagaaaaaatcaaaactgacaatggaccaggatattgtagtaaagctttccaaaaattcttaagtcagtggaaaatttcacatacaacaggaattccttataattcccaaggacaggccatagttgaaagaactaatagaacactcaaaactcaattagttaaacaaaaagaagggggagacagtaaggagtgtaccactcctcagatgcaacttaatctagcactctatactttaaattttttaaacatttatagaaatcagactactacttctgcagaacaacatcttactggtaaaaagaacagcccacatgaaggaaaactaatttggtggaaagataataaaaataagacatgggaaatagggaaggtgataacgtgggggagaggttttgcttgtgtttcaccaggagaaaatcagcttcctgtttggttacccactagacatttgaagttctacaatgaacccatcggagatgcaaagaaaagggcctccacggagatggtaacacc

SEQ ID NO: 32 - DNA, 95 bp, Homo sapiens
gcatttgttcttcaggtcacccacttgaacctcttccaagtgcactttcctttctttcctgccctaaaacattgtaattaacttccattccggct

SEQ ID NO: 33 - DNA, 689 bp, Homo sapiens
ttacagtaggtagctagtcatacatgagcagggcaggagagggattcccatcaccaggaatcacaggtgaccatcaggtggtggtcaggaagttgctaactgtctctctaaaataataattggtcatagccaacaccacggaaaagcagtctcccaatagatagaaaatacctgaaactggtgatcagcagcttcctgataaaatctcagtagttgggcaagtgggctgaagcatgtacattaagaggcaaaatggcagaatttaactggtacgtgacctctcagggacatttgagcagtaagggaagaacacctcaagttagcatgcatataactccagtaaacgcactgtgcatgctcccctcccaagtgctagcaggccactgtgcatgtggacagccaccccaagagaaaaatcagggtagaaggtaatgcaagaccctagaagtaggccagcaaataaacccccatgtcaaacagcacacttgatctctcaagtcacccacctggccgtcttccaagtatactttacttcctttctttcctgctgtaaagcttattaataaaccttaactcctcctctaaaacttgcctcagtttctccttctgcatcatgcccctgactcaaattcttctgaggaggcaagaattgaggttgttgcagacccatacagctttgctgctgctaa

SEQ ID NO: 34 - DNA, 763 bp, Homo sapiens
gagagacaggactagctggatttcctaggccagctaagagttcctaagcctagctggggaaggtgaccacgcccacctttaaacatggggctcctaactcagctgacacccaaccaatcagatagtaaagagagctcactaaaataccaattaggctaaaagcaggaggtaaagaaatagtcaatcatctgtcgcctgagagcacagggggagggacagtgattgggatataaacccaggcattcaagccggcagtggcaaccccctttgggtcccctcccgttgtatgggagctctgtttgcactctattaataatcttgcaactgcacactcttctggtccgtgtttgttccagcttgaactgagctttcacttgccgtccaccactgctgatcgccaccatcacagacccgccactgactttcacccctccagatcccgcagggcgtccgcctggcttctgatccagcgaggcacccgttgccgctcctgatcaggctagaggcttgctattgttcctgcaccgctaagtgactgggttcatcctaatcgggctgaacactagtcgctgggtttcaccgttctcttccgtgacccacggcttctaatacagcgataacactcaccgcatggcccaaggttccattcgttggaatccatgaggccaagaaccccaggtcagagaacaaaaggcttgccgccatctggggagcagcccgccaccatcttgggagctctaagaacaaagacctgccggtaaca

SEQ ID NO: 35 - DNA, 2689 bp, Homo sapiens
gggtcaggcacaaagtaagcccaccccactgggaactatgttaaaaaaaaaaaaattcaagaaagaattgaggaagcctggacaggtcccttgtttcaaaggtatggcacaaggtaacctgtaagccaaagcacccagaccagtttccgtacacagacagtaacagctggttttagaccccctttcctccccacagtagttaaaagaacagcagtataagcagctggcagaggcagcagagagaaaaggaaagaccagcagagagaaaaaaaggccatctaaaccaattgtaagttaatttagactaaacaaggtcttattaatagcaaaggataattgaaatcccaaacttacaaggttttcaacaaaagtgaagtttgctaaaagttaacagtgtaacatgtattatggtaacttctaatcttgtggccttagtcccaaagacataaagaaagtttgctttaaaaaaaggaatggttatcttcaaaaaaaaaaaaaaaagggggggggggcaggcagaatttaggtaaaaagagtgttatatggtaaattcttgtcctgaaataaattaactggttgtttaaagaaaaaaaaaatgtttgtaataagtcagaaagttgagacatgttgaaaaattgtcggcgaaagtcatgaaagaaaaaatgttataaaaattgtatgcaaaaaatgttgtataatttaaaagtaataaggcctcctgagtaccattaaaaaaaacagtttatgtgcgaagtgtataagaaaagtaaaatatacctttggtaaaaagattataaaggggcataataatgtagatttttacctacattaaaaggttaaaaaaattattgttttaaaagtttaagcaagctttaaaatgttaattataaagaaaattctgtgtgtaaacatattagctaaagttaaaaagatatcatccagtttttctgtgaactggacattaaagtaaaaatgcaacaagtttttcttaaagcatcaacctgctctttaacaaaaattataaaagattaaagagtctataaaatcttaccttatggtcaaacatgaaaaattggataaatatgtctacaaggctttattaaaattaagtttaacattaataacacactaatataaaggtaaaatttaacttatctggcataaaaatcacacaagaagcattattaaatataaaatggtgtttagctttctttggtctaaaaactaataaaaataggtgctaaaggaaacattcattttactagaggatcaagaaagttaaagacttaaaacaaacttcggcagttaagacagcataccaagatacaaatgcctggatgaaatggatcaaatattccatccgcacgttaaacaaagcaactgttatgcttgtgcacatggcaggttggcaggttagagaccctgattgtcccccttccactaaggtggtccttcagtcgaccaggcgtgggctgtatggtagctgttttccaggattctacagcctggagtaataagtcatgccaagctctctctgctgtatcctgaagtccctgcaggtcatccccgagggccatccagcttccgtctcccaacactaagttcacttcttgtctctcatggcaggggaggagacttagcattccttggagacctgaagggatgcagtgatcttaggaattttcaagagcttatcaatcagtcagcccttgttcatccccgagtggatttgtggtggtattgtggtggacttttactgggcactctgccaaataactagagtggcacttgtgctttagtccatttggctatccatttcaccctggcatttcatcagccagaggaaaaaaaataataataagacatcgtaaagcaagagaagccccttataggtctttcaactctcacatctatttagatgcaattggagccccacaaggaataccagatcaatttaaagcttgaaatcaaatagttgtaagatttaagtcaatattttggtagatgacagtcaataaaaatgtaaattagataaactacatctattacaaccaacagcaacgagcttttcgtaagttaaaaagaaaaacgcatgtcggccccagccctgaggctacctgacctgacaaaactctttacactctatgtgtcagaaagagaaaaaatggcagttggagttttaacccagactgtagggccctggccaaggccagtggcctatctctcaaaacaactagaaggggtttccaaagactggcccccatgtccaagggccctggtagcaacagacctgttagcacaagaaacagataagctaactcttgggcaaaacctaaacataaagtgtccccatgctgtggtgattttaataaataccaaaggacaccattagccaatgaatgttagactaactagataccaaagcttgctctgcaaaaatccccacataaccattgaagtttgcaacaccctaaccccaccaccttactcctggtatcagggagcccagtgaaacattaactgtgtagaggtgttagactctgtttattctagtaggcccaacctctgagaccacccttacacatcagtagactgggagctgtacgtggatgggagcagcttcgccagcccctgcaaagtgactctaaagaagatgacaagccctgctccagtcacacccggaagctga

SEQ ID NO: 36 - DNA, 9456 bp, Homo sapiens
gtggggaaaagcaagagagatcagattgttactgtgtctgtgtagaaagaagtagacataggagactccattttgttatgtactaagaaaaattcttctgccttgagattctgttaatctataaccttacccccaaccccgtgctctctgaaacatgtgctgtgtcaactcagagttaaatggattaagggcggtgcaagatgtgctttgttaaacagatgcttgaaggcagcatgctccttaagagtcatcaccactccctaatctcaagtacccagggacacaaaaactgcggaaggccacagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtaaaagaggaaggaatgcctcttgcagttgagacaagaggaaggcatctgtctcctgcctgtccctgggcaatggaatgtctcggtataaaacctgactgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacatgtttgtctgctgaccctctccccacaattgtcttgtgaccctgacacatccccctcttcgagaaacacccacagatgatcaataaatactaagggaactcagaggctggcgggatcctccatatgctgaatgctggttccccgggtccccttatttctttctctatactttgtctctgtgtctttttcttttccaaatctctcgtcccaccttacgagaaacacccacaggtgtgtaggggcaacccacccctacatctggtgcccaacgtggaggcttttctctagggtgaaggtacgctcgagcgtggtcattgaggacaagtcgacgagagatcccgaggacgtctacagtcagccttacggtaagcttgtgctctcggaagaagctagggtgataatggggcaaactaaaagtaaaattaaaagtaaatatgcctcttatctcagctttattaaaattcttttaaaaagagggggagttaaagtatctacaaaaaatctaatcaagctatttcaaataatagaacaattttgcccatggtttccagaacaaggaactttagatctaaaagattggaaaagaattggtaaggaactaaaacaagcaggtaggaagggtaatatcattccacttacagtatggaatgattgggccattattaaagcagctttagaaccatttcaaacagaagaagatagcatttcagtttctgatgcccctggaagctgtataatagattgtaatgaaaacacaaggaaaaaatcccagaaagaaacggaaggtttacattgcgaatatgcagcagagccggtaatggctcagtcaacgcaaaatgttgactataatcaattacaggaggtgatatatcctgaaacgttaaaattagaaggaaaaggtccagaattagtggggccatcagagtctaaaccacgaggcacaagtcctcttccagcaggtcaggtgcccgtaacattacaacctcaaacgcaggttaaagaaaataagacccaaccaccagtagcttatcaatactggccgccggctgaacttcagtatcggccacccccagaaagtcagtatggatatccaggaatgcccccagcaccacagggcagggcgccataccctcagccgcccactaggagacttaatcctacggcaccacctagtagacagggtagtgaattacatgaaattattgataaatcaagaaaggaaggagatactgaggcatggcaattcccagtaatgttagaaccgatgccacctggagaaggagcccaagagggagagcctcccacagttgaggccagatacaagtctttttcaataaaaatgctaaaagatatgaaagaaggagtaaaacagtatggacccaactccccttatatgaggacattattagattccattgctcatggacatagactcattccttatgattgggagattctggcaaaatcgtctctcttaccctctcaatttttacaatttaagacttggtggattgatggggtacaagaacaggtccaaagaaatagggctgccaatcctccagttaacatagatgcagatcaactattaggaataggtcaaaattggagtactattagtcaacaagcattaatgcaaaatgaggccattgagcaagttagagctatctgccttagagcctgggaaaaaatccaagacccaggaagtacctgcccctcatttaatacagtaagacaaagttcaaaagagccctatcctgattttgtggcaaggctccaagatgttgctcaaaagtcaattgccgatgaaaaagcccgtaaggtcatagtggagttgatggcatatgaaaacgccaatcctgagtgtcaatcagccattaagccattaaaaggaaaggttcctgcaggatcagatgtaatctcagaatatgtaaaagcctgtgatggaatcggaggagctatgcataaagctatgcttatggctcaagcaataacaggagttgttttaggaggacaagttagaacatttggaggaaaatgttacaattgtggtcaaattggtcacttaaaaaagaattgcccagtcttaaacaaacagaatataactattcaagcaactacaacaggtagagagccacctgacttatgtccaagatgtaaaaaaggaaaacattgggctagtcaatgtcgttctaaatttgataaaaatgggcaaccattgtcgggaaacgagcaaaggggccagcctcaggccccacaacaaactggggcattcccaattcagccatttgttcctcagggttttcagggacaacaacccccactgtcccaagtgtttcagggaataagccagttaccacaatacaacaattgtcccccaccacaagcggcagtgcagcagtagatttatgtactatacaagcagtctctctgcttccaggggagcccccacaaaaaatccccacaggggtatatggccccctgcctgaggggactgtaggactaatcttgggaagatcaagtctaaatctaaaaggagttcaaattcatactagtgtggttgattcagactataaaggcgaaattcaattggttattagctcttcaattccttggagtgccagtccaggagacaggattgctcaattattactcctgccatatattaagggtggaaatagtgaaataaaaataataggagggcttggaagcactgatccaacaggaaaggctgcatattgggcaagtcaggtctcagagaacagacctgtgtgtaaggccattattcaaggaaaacagtttgaagggttggtagacactggagcagatgtctctatcattgctttaaatcagtggccaaaaaattggcctaaacaaaaggctgttacaggacttgtcggcataggcacagcctcagaagtgtatcaaagtactgagattttacattgcttagggccagataatcaagaaagtactgttcagccaatgattacttcaattcctcttaatctgtggggtcgagatttattacaacaatggggtgcggaaatcaccatgcccactccattatatagccccacgagtcaaaaaatcatgaccaagatgggatatataccaggaaagggactagggaaaaatgaagatggcattaaagttccagttgaggctaaaataaatcaaaaaagagaaggaatagggtatcctttttaggggcggccactctagagcctcctaaacccataccattaacttggaaaacagaaaaactggtgtgggtaaatcagtggccgctaccaaaacaaaaactggaggctttacatttattagcaaatgaacagttagaaaagggtcatattgagccttcgttctcaccttggaattttcctgtgtttgtaattcagaagaaatcaggcaaatggcgtatgttaactgacttaagggctgtaaacgccataattcaacccatggggcctctccaacctgggttgccctctccggccatgatcccaaaagattggcctttaattataattgatctaaaggattgcttttttaccatccctctggcagagcaggattgtgaaaaatttgcctttactataccagccataaataataaagaaccagccaccaggtttcagtggaaagtgttacctcagggaatgcttaatagtccaactatttgtcagacttttgtaggtcgagctcttcaaccagttagagaaaagttttcagactgttatattattcattatattgatgatattttatgtgctgcagaaacgaaagataaattaattgactgttatacatttctgcaagcagaggttgccaatgcaggactggcaatagcatctgataagatccaaacctctactccttttcattatttagggatacagatagaaaatagaaaaattagccacaaaaaatagaaataagaaaagacacattaaaaacactaaatgattttcaaaaattactaggagatattaattggattcggccaactctaggcattcctacttatgccatgtcaaatttgttctctatcttaagaggagactcagacttaaatagttaaccccagaggcaacaaaagaaattaaattagtggaagaaaaaattcagtcagcgcaaataaatagaatagatcccttagccccatccaacttttgatttttgccactgcacattctccaacaggcatcattattcaaaatactgatcttgtggagtggtcattccttcctcacagtacagttaagacttttacattgtacttggatcaaatagctacattaattggtcagacaagattacgaataataaaattatgtggaaatgacccagacaaaatagttgtccctttaaccaaggaacaagttagacaagcctttatcaattctggtgcatggcagattggtcttgctaattttgtgggaattattgataatcattacccaaaaacaaagatcttccagttcttaaaattgactacttggattctacctaaaattaccagacgtgaacctttagaaaatgctctaacagtatttactgatggttccagcaatggaaaagcagcttacacagggccgaaagaacgagtaatcaaaactccatatcaatcggctcaaagagcagagttggttgcagtcattacagtgttacaagattttgaccaacctatcagtattatatcagattctgcatatgtagtacaagctacaagggatgttgagacagctctaattaaatatagcatggatgatcagttaaaccagctattcaatttattacaacaaactgtaagaaaaagaaatttcccattttatattactcatattcgagcacacactaatttaccagggcctttgactaaagcaaatgaacaagttgacttactggcatcatctgcactcataaaagcacaagaacttcatgctttgactcatgtaaatgcagcaggattaaaaaacaaatttgatgtcacatggaaacaggcaaaagatattgtacaacattgcacccagtgtcaagtcttacacctgcccactcaagaggcaggagttaatcccagaggtctgtgtcctaatgcgttatggcaaatggatgtcacgcatgtaccttcatttggaagattatcatatgttcacgtaacagttgatacttatttacatttcatatgggcaacttgccaaacaggagaaagtacttcccatgttaaaaaacatttattgtcttgttttgctgtaatgggagttccagaaaaaatcaaaactgacaatggaccaggatattgtagtaaagctttccaaaaattcttaagtcagtggaaaatttcacatacaacaggaattccttataattcccaaggacaggccatagttgaaagaactaatagaacactcaaaacccaattagttaaacaaaaagaagggggagacagtaaggagtgtaccactcctcagatgcaacttaatctagcactctatactttaaattttttaaacatttatggaaatcagactactacttctgcagaacaacatcttactggtaaaaagaacagcccacatgaaggaaaactaatttggtggaaagataataaaaataagacatgggaaatagggaaggtgataacgtgggggagaggttttgcttgtgtttcaccaggagaaaatcagcttcctgtttggatacccactagacatttgaagttctacaatgcacccatcggagatgcaaagaaaagcacctccgcggagacggagacaccgcaatcgagcaccgttgactcacaagatgaacaaaatggtgacatcagaacagatgaagttgccatccaccaagaaggcagagccgccgacttgggcacaactaaagaagctgacgcagttagctacaaaatatctagagaacacaaaggtgacacaaaccccagagagtatgctgcttgcagccttgatgattgtatcaatggtggtaagtctccctatgcctgcaggagcagctgcagctaactataccaactgggcctatgtgcctttcccgcccttaattcgggcagtcacatggatggataatcctatagaagtatatgttaatgatagtgtatgggtacatggccccatagatgatcgctgccctgccaaacctgaggaagaagggatgatgataaatatctccattgggtatcattatcctcctatttgcctagggagagcaccaggatgtttaatgcctgcagtccaaaattggttggtagaagtacctactgtcagtcccatcagtagattcacttataacatggtaagcgggatgtcactcaggccacgggtaaattatttacaagacttttcttatcaaagatcattaaaatttagacctaaagggaaaccttgccccaaggaaattcccaaagaatcaaaaaatacagaagttttagtttgggaagaatgtgtggccaatagtgtggtgatattacaaaacaatgaatttggaactattatagattgggcacctcgaggtcaattctaccacaattgctcaggacaaactcagtcgtgtccaagtgcacaagtgagtccagctgttgatagtgacttaacagaaagtttagacaaacataagcataaaaaattgcagtctttctacccttgggaatggggagaaaaaggaatctctaccccaagaccaaaaataataagtcctgtttctggtcctgaacatccagaattatggaggcttactgtggcctcacaccacattagaatttggtctggaaatcaaactttagaaacaagagatcgtaagccattttatactgttgacctaaattccagtctaacagttcctttacaaagttgcgtaaagcccccttatatgctagttgtaggaaatatagttattaaaccagactctcaaactataacctgtgaaaattgtagattgcttacttgcattgattcaacttttaattggcaacaccgtattctgctggtgagagcaagagagggcgtgtggatccctgtgtccatggaccgaccgtgggaggcctcgccatccatccatattttgactgaagtattaaaaggtgttttaaatagatccaaaagattcatttttactttaattgcagtgattatgggattaattgcagtcacagctatggctgctgtagcaggagttgcattgcactcttttgttcagtcagtaaactttgttaatgattggcaaaaaaattctacaagattgtggaattcacaatctagtattgatcaaaaattggcaaatcaaattaatgatcttagacaaactgtcatttggatgggagacaggctcatgagcttagaacatcgtttccagttacagtgtgactggaatacgtcagatttttgtattacaccccaaatttataatgagtctgagcatcactgggacatggttagacgccatctacagggaagagaagataatctcactttagacatttccaaattaaaagaacaaattttcgaagcatcaaaagcccatttaaatttggtgccaggaactgaggcaattgcaggagttgctgatggcctcgcaaatcttaaccctgtcacttgggttaagaccattggaagtactacgattataaatctcatattaatccttgtgtgcctgttttgtctgttgttagtctgcaggtgtacccaacagctccgaagagacagcgaccatcgagaacgggccatgatgacgatggtggttttgtcgaaaagaaaagggggaaatgtggggaaaagcaagagagatcagattgttactgtgtctgtgtagaaagaagtagacataggagactccattttgttatgtactaagaaaaattcttctgccttgagattctgttaatctataaccttacccccaaccccgtgctctctgaaacatgtgctgtgtcaactcagagttaaatggattaagggcggtgcaagatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtaaaagaggaaggaatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacatgtttgtctgctgaccctctccccacaattgtcttgtgaccctgacacatccccctcttcgagaaacacccacagatgatcaataaatactaagggaactcagaggctggcgggatcctccatatgctgaacgctggttccccgggtccccttatttctttctctatactttgtctctgtgtctttttcttttccaaatctctcgtcccaccttacgagaaacacccacaggtgtgtaggggcaacccacccctaca

SEQ ID NO: 37 - DNA, 3184 bp, Homo sapiens
gtcaggcctctgagcccaggccaggccatcgcatcccctgtgacttgcacgcatacatccagatggcctgaagtaactgaagatccacaaaagaagtaaaaacagccttaactgatgacattccaccattgtgatttgttcctgccccaccctagctgatcaatgtactttgtaatctcccccacccttaagaaggttctttgtaattctccccacccttgagaatgtactttgtgagatccacccctgcccagcagagaacaaccccctttgactgtaattttccattaccttcccaaatcctataaaacggccccacccctatctcccttccctgactctcttttcggacgcagcccgcctgcgcccaggtgaaatacacagccatgttgctcacacaaagcctgtttggtgggctcttcacacggacacgtatgcaatttggtgccgtgactcggatcgggggacctcccttgggagatcaatcccctgtcctcctgctctttgctccgtgggaaagatccacctatgacctcaggtcctcagaccgaccagcccaagaaacatctcaccaatttcaaatccggtaagcggcctctttttactctcttctccaacctccctcactatacccttagcggcaagtcccgctttcctggggcaggggcaggtacccctcaaccccttctccttcaccctcagcggcaagtcccgctttcctggggcaggggcaggtgcccctcgaccccttctccttcaccctcagcggcaagtcccgctttcctggggcaggggcaggtgcccctcaaccccttctccttcaccctcagcggcaagtcccgctttcctggggcaggggcaggtgcccctcgaccccttctccttcaccctcagcggcaagtcccgctttcctggggcaggggcaggtacccctcgaccctttctccttcaccctcagcggcaagtcccgctttcctggggcaggacttgccgctttcctggggtagggacaagtacccctgaaccccttctccacattacctgcttttcaagggcctgtttcccttgcctccataactgttgtgggtattgacagccaggcttctaaacctcttaaaactcccccactctggtgccaacttggacgacactcttttatgcactcttttttagttatccccacctgcccagttcccttattaggccgagatattttaaccaaattatctgcttccctgactattcctggactacagctgcaactcattgctgcccttctcgctaacccaaagcctccttcgcgtctttctttcatatccccccaccttaacccacaagtatgggacatctctactccttccctggcaactgatcacatgcccattaccatcccgttaaaacctaatcacccttaccccactcaacgccagtatcccatcccacagcatgctttaaaaggattaaagcctgttatcactcgcctgctacagcatgggcttctaaaacctataaactctccttaccattcccccattttacctgtcctaaaaccagacagggcttacaggttagttcagaatctgtgccttatcaaccaaattgttttgcctatccaccccgtggtgccaaacccatatactctcctatcctcaatacctgcctctacaacccattattctgttctggatctcaaacatgctttctttactattcctttgcacccttcatcccagcctctctttgctttcacttggactgaccctgacacccattaggctcagcaaattacctaggctgtactgccgcaaggcttcacagacagcccccattacttcaatcaagcccaaatttcttcctcatctgttacctatctcggcataattctcataaaaacacacgtgctctccctgccaatcgtgtccgactgatctctcaaaccccggcacctttctacaaaacaataactcctttccttcctaggcatggttagcgtggtcgtaattcttacacaagagccaggaccacaccctgtagcctttctgtccaaacaacttgaccttactgttttaacctagccctcatgtctgcgtgcagcggctgccgctgctttaatacttttagaggccctcaaaatcacaaactttatcagtcctccaggcccaagttgactcttcagctgcagttgtcctccaaaaccgccaaggccttgactgacttactgctgaaaaaggaggactctgcatattcttaaatgaggagtgttgtttttacctaaatgcatctggcctggtgtatgacaacataaaaaaactcaaggatagagcccaaaaacttgccaaccaagcaagtaattacgctgaacccccttgggcactctctaattggatgtcctgggtcctcccaattcttagtcctttaatacccatttttctcctccttttattcggaccttgtatcttccgtttagcttctcaattcatccaaaaccgtatccaggccatcaccaatcattctatacgacaaatgtttcttctaacatccccacaatatcaccccttaccacaagacctcccttcagcttaatctctcccactctaggttcccacgccgcccctaatcccgctcgaagcagccctgagaaacatcacccgttctctctccataccaccccccaaaaatttccgccgctccaacacttcaacgctattttgttttatttgtcttattaatataagaaggcaggaatgtcaggcctctgagcccaggccaggccatcacatcccgtgacttgcacgcatacatccagatggcctgaagtaactgaagatccacaaaagaagtaaaaacagccttaactgatgacattccaccattgtgatttgttcctgccccaccctaactgatcaatgtactttgtaatctcccccacccttaagaaggttctttgtaattctccccacccttgagaatgtactttgtgagatccacccctgcccagcagagaacaaccccctttgactgtaattttccattaccttcccaaatcctataaaacggcccaacccctatctcccttccctgactctcttttcggacgcagcccgcctgcgcccaggtgaaataaacagccatgttgctcacacaaagcctgtttggtgggctcttcacacggacgcgcatgaaa

SEQ ID NO: 38 - DNA, 543 bp, Homo sapiens
ttcaaatggagccccagatgcagtccatgactaagatctaccatggacccctggactggtctgctagcccacactccgatgttgatgacaccgaaggcacccctcccaaggaaatctcaactgcatgacccctactatgccccaattcatcaggaagcagttagagtggtcatcagccaacctcctcaacagcacttgggttttcctgttgagagtggggactgagagacaggactagctggatttcctaggccaactaagaatccctaagcctagctgggaaggtgaccacatccacctttaaacacggggcttgcaacttagctcatacccaacaaatcaggtagtaaagagagctcactaaaatactgattaggcgaaaacaggaggtaaggaaacagccagtcatctatcgcctgagagcacagcaggagggacaatgatcgggatataaacccaggccttagagctggcaacagctaccctctttgggtgcctttgtatgggagctctgttttcactctattaaatcttgcaactgca

SEQ ID NO: 39 - DNA, 967 bp, Homo sapiens
gtggggaaaagaaagagagatcagactgttactgtgtctatgtacaaagaagtagacataagagactccattttgttctgtactaagaaaaattcttctgccttgagatgctgttaatctgtaaccctacccccaaccctgtgctcacagaaacatgtgctgtgtcgactcaaggtttaatggatttagggctatgcaggatgtgctttgttaaacaaatgcttgaaggcagcatgcttgttaaaagtcatcaccactccctaatctcaagtatccagggacacaaaacactgcggaaggccgcagggacctctgcctaggaaagccaggtattgtccaaggtttctccccatgtgatagcctgagatatggccttgtgggaagggaaagacccgaccgtcccccagcccgacaccctttaaagggtctgtgctgaggagaattagtaagaggaaggcctctttgcagttgagataagaggaaggcatctgtctcctgcatgtgcctgggcaatggaatgtctcggtgtaaaacccgattgtattattccatctactgatataggagaaaaccgccttacggctggaggtgagacatgctggcagcaatactgctctttaatgcaccgagatgtttatgtatgtgcacatcaaagcacagcacctttttcttaaccttgtttatgacacagagacatttgttcacatgttttcctgctgaccctctccccactattaccctattgtcctgccacatccccctctccgagatggtagagataatgatcaataaatactgagggaactcagagacctatgccagcgtggtcctctgtatgctgagcgccggtcccctgggcccacttttctttctctatactttgtctctgtgtctctttcttttctcagtctctcatcccaaccgacgagaaacacccacaggtgtggaggggcaggccaccccttca

SEQ ID NO: 40 - DNA, 965 bp, Homo sapiens
gtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacaggtgtggaggggcaacccaccccttca

SEQ ID NO: 41 - DNA, 129 bp, Homo sapiens
gtcaggcctctgagcccaagctaagccatcatatcccctgtgacctgcaagtagacatccaaatggcctgaagcaactgaagctccagaaaagaagtgaaaatagccttaactgatgacaatccaccat

SEQ ID NO: 42 - DNA, 973 bp, Homo sapiens
ttctttaacaaacaattgctggctttgcgtttctctttcctccaaaattgccaaggccttgacttacttactgctaaaaaaggaagactgtacattttttaatgaagagtgttgtttttacctaaatcaatctggcctggtgtatgacaacataaaaaaactcaaggacagagcccaaaaactcaccaaccaagcaagtcattatgctgaaccctcttgggcactctctaattggatgtcctgggtcctcccaattcttagtcctttaatacctgtttttttccttctcttattcagaccttgtaacttctgcttagtttctcaattcatacaaaaccatatccaggccattctatacaacaaatgttccttctaacaaccccacactatcacccctcaccccaaaatctttcttcagcttaatctctcccactctaggttcccacgccgcccctaatcccgcttgaagcagccctgagaagcatcacccattatctctccataccacctgccaaaaatgttcgctgccccaacacttcaacactattttatgttatttttcttattcatataagaagataggaatgtcaggcctctgagcccaagctaagtcatcatatccactgtgacatgcatgtatacatccagatggcctgaagtaactgaagaatcacaaaagaagtgaaaatggcctgctcctgccttaactgatgacataaccttgtgaaattctttctcctgtctcagaagctcccccactgagcaccttgtgacccctgcccccgcctgccagagaacaaccccctttgactgtaattttccattacctacccaaatcctgcaaaatggccccacccctatctctcttccctgactctcttttcggactcagcccacctgcacccaggtgaaataaacagccctgttgctcacataaagcctgccggtggtctcttcacagggacgtgcgtga

SEQ ID NO: 43 - DNA, 6661 bp, Homo sapiens
gtcacacctctgagcccaagctaagccatcatatcccctgtgacctgcatgtatatatccagatggcctgaagcaagtgaagaatcacaaaagaagtgaaaatggcctgttcctgccttaactgatgacattaccttgtgaaattccttctcctggctcagaacctcccccattgagaaccttgtgacccccacccctgaccgccagagaacaaccccctttgactgtaattttccactacctacccaaatcctataaaacagccccacccctatctcccttcgcggactctctttttggactcagccagcctgttcccaggtgaaataaatagccttgttgctcacacaaagactgtttggtggtctctttacacagatgcacgtgacatttggtgccgaagacccaggataggaggactcctttgggagaccggtcccctgtcctcgccctcactccataaggagatccacctacaacctcgggtcctcagaccaaccagcccaagcaacatctcaccaatttcaaattgggtaagctgtcttttcactctcttctccagcctctcttgctacccttcaatctccctgtccttccaattccagttctttttcctcgctagtagagacaaaggagacacttttatccgtggacccaaaactccagcgccagtcacagactcgggaagacagtcttcccttggtgtttaatcactgctgggatgcctgcctaattattcacccacactccatttgtgtctgatcaccactgggatgcctgccttggtcattcacccacatttccttagtggcaagtcaattgtggggatgcctgctttggctgctcacccacattgcagcccagggctgctcactacccaccccttctctgtgtctctaccctctcttttctctgggcttgcctccttcactatgggcaaccttccaccctccattcccccttcttctcccttatcctatgttctcaaaaacttaaaacctcttcaattctcacctgacctaaaacctaagcattttattttcttctgcaacactgtttggccccaatacaaactcgataatggttctaaatagccagaaaatggtacttttgatttctccattttacaagacctggatgatttttgttgaaaaatgggcaaatgatctgaggtgcctgatgtccaggcattcttttacacatcggtccctccctagtctccgttcccaatgcaactcatcccaaatcctccttctttccctcccacctgtcccttcagtcccaaccccaagtgtcactgagtcttttgaatccttttctacagacccatctgacctctcctccccagactgctccttgccaggccgagtcaggtcctgattcttcctcagcctctcttccccaaccctataatcctttatcacctcccctgctcacacctggtctggcttacagttttgtttcgtgactagctctcccccacctgcccagcaatttcctcttaaaaaggtggctggagctaaaggcatagtcaaggttaatgctcctttttctttatctgacctctcccaaatcagttagcgtttaggctctttatcatcaaatataaaaacacagcgcagttcatggcctgtttggcaacaacccttagacactttacagccctagaccctgaagtgtcagaaggccatcttattctcaatatgcattttattacccaatctgctcccaacattaaataaaactccaaaaattatattctggccctcaaaccccacaacaggacttaattaacctcaccttcaaggtgtacaataatagagaagagttgcaattactttcctctgctgtgagagaaaccccagccacatctccagcacacaagaacttcaaaacgcctaagccacagcagtcaggtgttccttcaggacctcctcccccaggatcttacttcaagtgctggaaatctggccactgggccaaggaatgcccacagcccaggattcctcctaagccatgtcccatctgtgtgggaccccactggaaattggactgtccaattggcccaaggctctgactgactctttcccatatcttctcggcttagcagctgaagactgatgctgctctgatcacctcggaagcctcctggaccatcatagacactttgagtaactcttacagtggagggtaagtccttccccttcttaatcaacacagaggctgcccattccatattaccttcttttcaagggcctgtttcccttgtctccataactgttgtgggtattgatggccaggcttctaaacctcttaaaactccccaactctggtgccaacttggacaatattcttttatgcactcctttttagttatccccacctgcccagttcccttatcaggtctaggcattttaactaaattatttgcttccctgactattcctaggctacagccacacctcattgctaccctttttcccagttcaaagcctcctttgcctcctccccttgtttctccccaccttaatccacaagtataggacacctctactccttccttggcaaccgaacatgcaccccttaccatcctgttaaaacctaaccacccttatgccactgaatgccaatatcccatcccacagcactctttaaaaggattaaagcctgttatcactcacctgttacagcatggtcttttaaagcctataaactcttcttacaattcccccattttacctgtccaaaaactgggcaagtcttacaagttagttcaggatctgcaccttatcaaccaaattgttttgcctatccactccgtggagccaaacccatatactctcctatcctcaatacctccctccacaacccctccacaacccgttattctgttctggatctcaaacatgctttctttactattcctttgcacccttcatcccagcctctcttcgctttcatttggactgaccctgacacccattgggctcagcaaattacctgggctgtactgccacaaggcttcacggacagcccccattacttaagtcaagcccaaatttattccccatctgttacctatctcggcataattcttcatgaaaacacacaagctctccctgctaatcatgtctggctaatcttctgaaccccaaccctttctataaaacaacaactcctttccttcttaggcatggttaggtacttctgcctttggatacctagttttaccatcctgactaaacgattatataaactcagaaaagcaaacctagcttaccccatagatcctaaatcctttccccactcccctttccattccttgaaaaacagctcccacactagctctccctaactcatcactcccttttcattacacacagctgaagtgcagggctgtgtggtcagagttcttacagaagagctgggactgcgccctgtagcctttctgtccaaacaacttgaccttactgttttagcctagccctcatgtctgtgtgctgtggctgccgctgctttaatattttagaggccctcaaaatcacaaactatgctcaactcactctctacagttctcataacttccaaaatctattttcttcctcacagctaacacatatactttctgctccccagctccttcagctatactcactctttgttgagcctcccacaattaccattgttcctggcccagacttcaatccaggctcccacattattccggataccacacctgacccccatgactatatctccctgatccacctgacattcactccatttccccatatttccttctttcttgttcctcactctaatcacacttggtttatcaatggcagttccaccaggcctactcgccgctcatcagcaaaggcaggctatgctatagtatcttccacatctatcattgaggctaccactctgccccctccaccagctctcagcaagtcgaactcattgccttaacttgaaccctcactctcacaaatattgatgatgtgtcaatattcatactgactctaaatataccttccatatcctgcaccaccatgttgttatatgggctgaaaaaggtttcctcgctatgcaagggtcctccatctttaatgcctctttaataaaaactcttctcaaggccgctttacttccaaaggaagctggagtcattcactgcaagggccatcagaagacgtcagatctcatagctcaggacaacgcttatgctgctgaggtagctaaagaagcagctagcattccaacttctgtccctcatggccagtttttctccttctcatcggtcactcccacctactcccccactgaaacttccacctatgaatctcttcccacacaaggcaaatggttcttagaccaaggaaaatatgtccatgtccttccagcctcacaggcctattctattccatcaacatttcataacctcttccatgtaggttacaagccactagcccacctcttagaacctctcatttcctttccattgtggaaatctgtcctcaaggaaatcacctctcagtgttccatctgctattctagtactcctcagggatttttcaggtcccctcccttccatacacatcaggctcagggatttacccctgcccaggactggcaaattgactttacttacgtgtctcgagtcaggaaactaaaatacctcttggtctgggtagacactttcactggttaggtagaggcctttcccacagggtctgaaaaggccaccatggtcatttcttcccttctgtaagacataattccttggtttggccttcccacctctatacagtccaataacggactggcctttattagtcaaatcacccaagcagtttttcaggctcttggtattcagtggaaacttcataccccttaccgtcctcaatcatcaggaaaggtagaacagactaatggttttttaaaaacacacctcagcaaactcaacctccaacttaaaaaggaggactctgtcaaggatagagctcaaaaacttgccagcaaagcaagtaattatgctgaacccccttggacactctctaattggatgtcctgggtcctcccaattcttagtcctttaatacctatttttctccttctcttattcagaccttgtgtcttctgtttagtttttcaattcatacaaaactgcatccaggccatcaccaatcattcgatatgacaaatgctccttctaacaaccccacaatgtcaccccttaccacaaaatcttccttcagcttaatctctcccactctaggttcccacgctgcccctaatcccgctcaaagcagccctgagaaacatcgcccattatctctccataccactcccaaaaattttcactgccccaacacttcaacactattttatttttcttattaatataagaaaatattaataaatgtcaggtctctgagcccatgcctgcacgtattcatccagatgacctgaagcaagtgaagaatcacaaaagaagtgaaaatggccagttcctgccttaactgatgacattactttgtgaaattccttctcctggctcatcctggctcaaaagctcccccactgagcaccttgtgacccccaacccctgccaaccagagaacaaccccctttgactgtaattttccattacctacccgaatcctataaaatggccctacccctatctcccttcactgactttcttttcagactcagcccacctgcatccaggtgattaaaaagctttattgctcacacaaagcctgtttggtggtctcttcacatggacgtgtgtgaaaaaaatgtaccccactagttacccaaagcaggctaattggtgctgtagttatttcctttgggtcaggtttctcatcagtatagtccctttatagtttgccaaaaagctgttctggaaagggcttttgattcacaccccaagaaagggttcttggatctcatgcaagaaagaaagaagccaaggtgagtccatgcagtaaagtgaaaccaagtttattagagaagtaaagaaacaaaaagatggctgctccataggcagagcagctaatatgatttatgtctcttaaattggctttgaccataggagagattgagacaattctgtaagcccagcacctaggtgatgtgacttttcatcttttgcttagaccctgtgcacaaaaggaagagtggcttatcactgggcctcacacacaggtgacctaactgtcaggcctctgagcccaagctaagccatgatatcccctgtgacctgcaggaatacatgcggatggcctgaagcaagtgaagaatcacaaaagaagtgaaaattgctggttcctgccttaactgatgacattccaccattgtgatttgttcctgccccaccttaactgagccattaatgttgtgaaattccttctcctggctcagaacctccctcactgagcaccttgtgacccccacccctgcctgcaagagaaaaaccccctttgactgtaattttccactacccgcccaaatcctttaaaacggccccacccctatctcccttcgctgactcttttttcggactcagcccgcttgcacccaggtgattaaaaagctttattgcttacacaaagcctgtttggtggtctcttcacgcggttgcgcatga

SEQ ID NO: 44 - DNA, 949 bp, Homo sapiens
gtggggaaaagagagagagatcagactggtactgtgtctatgtagaaagaagtagacgtaagagactccattttgttctgtactaagaaaaattcttctgccttgagatgctgttaatctgtaaccctacccccaaccctgtgctcacagaaacctgtgctgtgtcaactcagggttaaatggatttagggctatgcaggatgtgctttgttaaacaaatgcttgaaggcagcatgcttgttaaaagtcaccaccactccctactctcaagtacccagggacacaaaacagtacggaaggccgcagggacctctacctaggaaaaccaggtattgtccaaggtttctccccatgtgatagtctgaaatgtggcctcgtgggaagggaaagacctgaccgtcccccagcccgacacccgtaaagggtctgtgctgaggaggattagtaaaagaggaaggcctctttgctgttgagataagaggaaggcatctgtctcctgctcgtccctgggcaatggaatgcctcggtgtaaaaccccattgtatattccatctactgtgataggagaaaacagccttagggctggaggtgagacatgctggaggcaatactgctgtttatgtatatgcacatcaaaagcacagcacttttttctttaaccttgtttatgatgcagagacatttgttcacatgttttcctgctcaccctctccccactattactctattgtgctgccacatccccctctctgaaatggtagagataatgatcaataaataccgagggaactcagagactggtgccggcgtgggtcctcggtatgctgagtgccggtcccctgggctcacttttctttctctatagtttgtctctgtgtctcttttctcagtctctcatcccacccgacgagaaacacccacaggtgtggaggggcaggccaccccttca

SEQ ID NO: 45 - DNA, 122 bp, Homo sapiens
gtcaggactctgagctaagccatcatatcccctgtgacctgcccttatacatccagatggcctgaagcaactgaagatccacaaaagagtgaaaatagccttaactgatgacattccaccat

SEQ ID NO: 46 - DNA, 160 bp, Homo sapiens
ccaagagtaatggtcaggcgattaactgtctctctaaagtaataattggtcacagcagtgccaggaaaggcagtctcctaatagaaaaaaaaaaaaacacctaaaactggtgatcagcagcttcccagtaagatctcaggagttgggagagtggcaagca

SEQ ID NO: 47 - DNA, 294 bp, Homo sapiens
tgggtcaagcacaaagtaagcccaccccaccaggaactatgttgaaaatttcaagatttaagggagactatggagtactatgacaccaggaaaacttaaaactttgtgtaagatagactgaacagcattagaggtgggttggccaccagaaggaagcctggacaggtcccttgtttcaaaggtatggcacaaggtaacctgtaatccagggcacactgaccagttcctgtatatagacacttggttacagctggttttagactgccccccacagtggttgagagaacagcagca

SEQ ID NO: 48 - DNA, 3054 bp, Homo sapiens
gctttgggtaacttacagtggagggtaagtccatccccttcttaatcaatacagaggctaccaagtccatattaccttcttttcaagggcatgtttcccttgcctccataactgttgtgggtattgacggccaggcttctaaatctcttaaaactccccaactctggtgccaacttggacaacattctttaatgcactcctttttagttatccccacctgcccagctcccttatcaggtggagatattttaactaaattatctgctgccctgactattgctgggctatagccacaactcattgctgccttttgtcccagttcaaagccttcttcacatcctctccttgtatatccccaccttaatccacaagtataggatacctctactccctccttggcaatggatgatgcacccgttaccatcccattaaaacctaatcacccttaccccactcaatgccaacatcccatcccacagcatgctttaaatggattaaagcacttgcctgttacagcatggccttttaaagccaataaactctccttacaattccctcattttacctgtccaaaaaccagacaagccttataggttagttcagtatctgtgccttatcaaccaaattgtcttgcctgtccactccatggtgtcaaaaccatatactctcctatcctcaatgcctccttccacaacccctccataacccattattctgttctggatatcaaacatgctttctttattgttccattgcaccttttatcccagcctctctttgctttcacttgcactgaccctgacacccatcagcctcagcaacttacctgggctgtactgccgcaaggcttcgcggacagcccccattacttcagtcaaacccaaatttctccctcatctgttacctatctcagcataattcctcatgaaaacacatgtgctctccctgttgattgtgtctggctaatctcccaaacccaaccccttctacaaaacaacaactcttttccttcctaggcatggttaggtacttccgcctttggatacctagttttaccatcctgactaaaccattatgtaaactcacaaaagcaaacctagctgaccccatagatcctaaatccttttgccgctcctctttctgttccttaaaaacagccccagaagctgccccaatgctggctttccctaactcatcccaacccttttcattacacacaggcaaggtacagggctgtgcggtcaaaattcttacacaagagccaggaccatgccctgtaggctttctgttcatacaacttgaccttactgttttaggctggcccccaccccagtgactatatctctctgatccacctgacattcactccatttccctgtagttccttctttcatgttcctcaccctgatcacacttggtttattgatggcagttccaccaggcctaatctccactcaccagcaaaggcaggctatgctagagtatcttccacatctatcattgaggctaccactctgcccccctccattacctctcagcaagctgaactcattgccttaacttgagccctcactcttgcaaaggaattttgtgtcaatatttatagtgactctaaatatgccttccatatcctgcaccaccttgctgttatatgggctgaaagaggtttcctcactatgcaagggtcctccatcattaatgcctctttaataaaaactcttctgaaggccactttacttccaaaggaagctggagtcatacactgcaagggccaccaaaaggcatcagatcctatcactgagggcaacgcttatgctgataaggtagctaaagaagcagccagcattccaacttccatccttcatggccagtttttctccttctaattggtcactcctatttactctcctactgaagtttccacctatcaatctcttcccacacaaggcaaatggttcttggaccaaggaaaatacctccttccagcctcacaggcccattctattctgtcatcatttcataacctcttccatgtaggttacacactgttagctcctctcttaaaacctctcatttcctttccatcatgaatatctatccccagtcctccactcttgactccctcttggagtggatagatgatctttgctgacaggacacactccaacactttcaccctgatgaagtcctattctttacttttatactcactcttattctcattcccattcttatgccaccctctacctctcctcagctatctccaccacactatcaatctcactcactctctcctagccatttctaatccttctttaacaaacaattgctggctttgcatttctctttcctccaaaatcactgaggcctcaatttactcactgctgaaaaaggaggattctgtgtatttttaaattaagaatgttgtttttacctaaatcaatctggcctggcatatgacaacataaaaaaactcaaggatataaaaactcaccaaaaaaccgcccaaaactcaccaaccaaacaaataattatgctgaacacccttgggcactctctaattggatgtcctgggtcctcccaattcttagtcctttaatacctgtttttcttcttctcttattcagaccttgtgtctttcgtttagtttctcaattcatacaaaaccgcatccaggccatcaccaataattctatacaacaaatgcttcttctgacaactccacaatatcactccttaccccaaaatctttcttcagtttaatctctcctactctaggttcccacaccgcccctaatcccacttgaagcagccctgagaaacatcacctattatctctccataccacccccccaaatttttgctgccccaacacttcaccactattttgttttgtttttcttattaatatatgaagacagaaatgtcaggcctctgagcacaagctaagccatcatatcccctgtgaactgcgtgtatacatccagatggcttgaagcaactgaagatccacaaaagaagtgaaaatagccttaactgatgacattccaccat

SEQ ID NO: 49 - DNA, 755 bp, Homo sapiens
gagaaacaggactagctggatttcctaggccgactaagaatccctaagcctagctgggaaggccgcatccacctttaaacacggggcttgcaactcagctcacacccaaccaatcagagagctcactaaaatgctaattaggcaaaaacaggaggtaaagaaatagccaatcatctattgcctgacagcacggcgggagggacaaggatcgggatataaacccaggcattcgagcgggcaacggcaaccccctttgggtcccctccccttgaatgggagctctgttttcactctgtttcactctattaaatcttgcaactgcactcttctggcccgtgtttgttagggctcgagctgagcttttgctcgccatccaccactgctgttttgccgccgtcgcagacccaccgctgacttccattcttccggatccggcagggtgtccgctgtgctcctgatccagcgaggcgcctattgccactcccgattgggctaaaggcttgccattgttcctgcatggctaagtgcctgggttcgtcctaattgagctgaacactagtcactgggttccacggttctcttccgtgacccacagcttctaatagagctataacactcactgcatggcccaagattccatttcttggaatccatgaggccaagaaccccaggtcagagaacacgaggcttgccaccatctcggaagcagcttgccaccatcttggaagctctgtgagcaaggaaccctggtaaca

SEQ ID NO: 50 - DNA, 461 bp, Homo sapiens
agtcaggtgtgagcagggaaggagagggctcccccactactcacacaccaggtgtgtcgggaggccatcctgtgaggtcaggcggttgttaactgtttctctacagtaataattggtcacagctggcactagggaaagacagtctcgtaccagatagaaaacagctgaaactggtgatcagcagcttccggatcagatctcagcgttggatgagcaggagaagcaacgcaagacctcggaagcctgccaaggtataaaaccccaagtcaaaagttcaaaccgtgctggtctttcaaatcgcccgcttggccctctttcaagtgtactttccttcctttccttcctgctctaaagcttttgaataaactttcacgcctgctctaaaacttgtcttggtctctccttctgcccctcagtcaaattgtttcttctgaggaggcaagaattgaggttgctgcaga

SEQ ID NO: 51 - DNA, 717 bp, Homo sapiens
tagtcaggcagacatgagcagggtaggagagtccccctcaccccctcaccaggaatgtcagatgaccatcaggtgatggtcaggcagttgttaactgtctctctaaaataattggttgcagccagcaccagggaaaggcagtctcccaatagatagaaaaagcctgaaactgatgatgagcagcttcctgataacatctcaggagttgggtgaactgggctcactcatgtgcactaagagacaaaattgtggtgtttaactggtgtatgaccttctaggaacattcaactggtaggggaagaacacctcaagtgagcatatgtacaactccagtaaacacactgtgcatgcggcccctcccaagtgctgacgggccactgcacttgtggacagttcactccagtggaagaatcaggggagaagagatgcagatcctggaagaactccaacatataaaaccccaagtcaaagatcaaactgtgcacttgactctctcaagttgcccacttggccctttttgaagtatactttacctcctttgattcctaccctaaaactttttagtaaattttcacgcctgctctaaaatttgctttggtctctcactctgccttatgctcctcagtcaaattctttcttctgaggaagtaagaattgaggttgctgcagacccgtacatacatacagatttgctgctgctagcatactttggtgcca

SEQ ID NO: 52 - DNA, 4377 bp, Homo sapiens
caaacttgacagtagttccaaatagccagaaaatggcactttgaatttttccatcctgcaagatctaaataattcttataataaaataggcaaatggtctgaggtgcctgacatccaggcattcttttacaaatcagtcccttcctagtctctgtgcccagtgcaactcgtcccaagtcttccttctttccctcccgcctgtcccctcagtaccatcccaagcgttgctgagtctttctaatcttccttttctacagacccatctaacctgtcccttcctccccaggctgctccttgccaggccgagctaggtcccaattcttcctcagcctccgctcctccaccctataatctttttatcgcctcccctcctcacgcctggtctaccttacagtttccttctgtgactggccctccccgacctgcccagcaatttactcttaaaaaggtggctggagctaaaggcatagtcaaagttaatgctcctttttctttatcccaaatcagatagcgtttaggctctttgtcatcaaatataaaaacccagcccagttcatgacttgtttggcagcaaccctgagacgctttacagccctagaacctaaaaggtcaaaaggccgtcttattctcaaaatacattttattacccaatctgctcccgacattaaataaaactccaaaaattaaattccggccctcaaaccccacaacaggatttaattaacctcgccttcaaggtgtacaataatagaaaaaagttgcaattccttgcctccactgtgagacaaaccccagccacatctccagcacacaagaacttccaaacacctgaaccgcagccgccaggtgttcctccagaacctcctcccagaggagcttgctacacgtgccggaaatctggccactgggccaaggaatgcccgcagcctgggattcctcctaagcttcgtcccatctgtgtgggaccccactgaaaatcggactgttcaactcacctgacacccactcccagagcccctggaactctggcccaaggctctctgactgattccttcccagatcttctcggcttagtggctgaagactgacactgcccgatcacctcggaagccccctagaccatcacggacgccgagcttcgggtaactctcacagtggaaggtaagcccgtccccttcttaatcaatacggaggctacccactccacattaccttcttttcaagggcctgtttcccttgcctccataactgttgtaggtattgacagccaggcttctaaacctcttaaaattccccaactctggtgccaacttagacaatactctttaaagcacccctttttagttatccccacctgcccagttcccttattaggctgagacactttaactaaattatgcacttctgtgactattcctggactacagctatatctcattgccgctcttcttcccaaagaaggctcttcccaaagcctcttttgcctcttcctcttgtatccccccaccttaacccacaagtataagatacctctactccctccttggcgaccgatcatgcaccacttaccatctcattaaaacctaatcacctttaccccactcaacgccaatatcccatcccgcagcacactttaaaaagattaaagcctgttatcactcgcctgctagagcatggccttttaaaacctataaactctccttacaattcccccattttacctgtcctaaaaccagacaagtcttacaatttagttcaggatctgcgccttatcaaccaaattgttttgcctatccaccccatggtgccaaacccatatactctcctatcctcaatacctgcctctacaacccattattctgttctagatctcaaacatgctttctttactattccgttgcacccttaatcccagcctctcttcgctttcacttggactgaccctgacacccatcaagttcagcaatacctaggctgtactgccgcaaagcttcacagacagcccccattacttcaatcaagcccaaatttcttcctcatctgttacctatctcggcataattctcataaaaacacacgtgctctccctgccaatcgtgtccaactgatctctcaaacccaagcaccttctacaaaacaacaactcctttccttcctaggcatggttagcgcggtcagaattcttacacaacagccaggaccacaccctgtagcctttctgtccaaacaacttgaccttactcttttagcctagccctcatgactgcgtgcagcggctgccgctgctttaatatttttagaggccctcgaaatcacaaattgtgctcaactcactctctacagttctcataacttccaaaatctattttcttcctcatacctgatgcatatactttctgcttcccggctccttcagctatactcactctttgttgagtctcccacaattaccattgttcctggcccagacttcaatctggcctcccacattattcctgataccacacctgacccccatgactgtatctctctgatccacctgacaatcacatttccccaaatttccttctttcctgttccttaccctgatcacgcttgatttattgatggcggttccaccaggcctaatcgccacacaccagcaaaggcaggttatgctatagtacaaggcactagcccgcctcttagaacctctcatttcctttccatcatggaaatctatcctcaaggaaattacttctcagtgttccatctgctattctactactcctcagggattattcaagccccctcccttccctacacatcaagctccaggatttgccccacccaggactggcaaattagctttactcaacatgccctgagtcagataactaaaatacctcttagtctaggtagacactttcactggataggtacaggcctttcctacagggtctgagaaggccaccgcagtcatttcttcctttctgttagagacataattcctcagtttagccttcccacatcaatacagtctggtaacagttgagcctttattagtcaaatcagccaagcagtttttcaggctcttagtattcagtgaaacctttatatcccttatggtcctccatcttcaagaaaagtagaatggaccaaaggtctttaaaaaacacacctcaccaagctcagccaccaacttaaaaagaactggacaatacttctaccaccttctcttctcagaattcaggcctgtcctcagaatgctacaggatacagcgcatttaagctcctgtatagatgctcctttttattaggccccagtcttattccagacaccagaccaacttagactgtgccccccaaaaaacttgtcatccttactatcttctgtctagtcatactcctattcaccgttctcaactactcatacatgccctgctcttgtttacactgccggtttccactgtttttccaagccatcccagctgatatctccttgagatatccccaaactgccactcttaactcttgaagtaaataaataatctttactggcaagactatgctgaatctccttaggcactctctaatcagatatcctgagtcatcccaattcttagaccttttatacctgtttttctccttctgttattccatttcgtttctcaattcatccaaaaccgtatccaggccatcaccaatcattatatacgacaaatatttcttctaacatccccacaatatcaccccttaccacaagacctcctttcagcttaatctctcccactctaggttcccacgccgcccctaatcccgcttgaagcagccctgagaaacatcgcccattctctctgcataccaccccccaaaaatttacaccgccccaacacttcaacactattttgttttatttttattattaatataagaaggcaggaatgtcaggcctctgagcccaagccaagtcatcgtatcccctgtgacttgcacgtatacgcccagatggcctgaagtaactgaagaatcacaaaagaagtgaatatgccctgccccaccttaactgatgacattccaccacaaaagaagtgtaaatggctggtccttgccttaagtgatgacattaccttgtgaaagtccttctcttggctcatcctggctcaaaaagcacccccactgagcaccttgcgacccccactcctgcccgccagagaacaaactccctttgactgtaattttcctttacctacccaaatcctataaaatggccccacccctatctcccttcgctgactctcttttcggactcagcccgcctgcacccaggtgaaataaacagccatgttgctcacacaaagcctgtttggtggtctcttcacagggacgtgcatgaaa

SEQ ID NO: 53 - DNA, 958 bp, Homo sapiens
gtggggaaaagcaagagatcagattgttactgtctgtgtagaaagaagtagacataggagactccattttgttctgtactaagaaaaattcttctgccttgagattctgttaatctatgaccttacccccaaccccctgctctctgaaatacgtgctgtgtcaaactcagggttaaatggattaagggttgtgcaagatgtgctttgttaaacagatgcttgaaggcagcatgctcgttaagagtcatcaccactccctaatctcaagtacccagggacacaaacactgcggaaggccgcagggacctctgcctaggaaagccaggtattgtccaaggtttctccccatgtgatagactgaaatatggcctcgtgggaagggaaagacctgaccgtcccccagcctgacacccgtaaagggtctgtgctgaggaggattagtataagaggaaggcatgcctcttgcacttgagacaagaggaaagcatctgtctcctgcctgtccctgggcaatgcactgtctcggtataaaacccgattgtacgttccatctactgagttagggaaaaaccgccttagggctggaggtgggacatgcgggcagcaatactgctttgtaaagcattgagatgtttatgtgtatgcatatctaaaagcacagcacttgattctttactttgtctatgatgcaaagacctttgttcacatgtttgtctgctaatcctctccccactattgtcttgtgaccctgacacatccccctctcagagaaacacccacgaatgatcaataaatactaagggaactcagaggctggcgggatcctccatatgctgaacgctggttccctgggtccccttatttctttctctatactttgtgtctttttcttttccaagtctctcgttccacctaacaagaaacacccacaggtgaggaggggcaacccaccccttca

SEQ ID NO: 54 - DNA, 781 bp, Homo sapiens
gtcaggcctctgagcccaagctaagccatcatatcccctgtgaactgcgcgtatacatcagatggcctgaagcaactgaagatccacaaaaagaagtgaaaatagccttaactgatgacattccaccattgtgatttgtttctgccccacgctaactgatcaaggtaccttgtaaactcccccatccttaagaaggttcattttcttttatttttttttttttttttttgagacggagtctcgctctgtcgccaaggctggagtgcagtggcacgatctcagctcactgcaagctccgcctcccggattcaaggcattctcctgcctcagcctcccgagtaactgggactacaagcgcccgccaccacaaccggctaatttttatatttttagtagagacggggtttcaccatgttagccaggatagtctcgatctcctgacctcgtgatccacctgcctcggcctcccaaagtgctgggattacaggcgtgagccaccacgcccggccaagaaggttctttgtaatctcccccatccttaagaaggttctttgtaattctccccacccttgagaatgtactttgtgagatccactgcctgcccgcaaaacattgctcctaactccaccgcctatcccaaaacctgtaagaactaatgataatcccaccatcctttgcagactctcttctcgggctcagcccgcctgcacccaggtgaaatacacagccttattgctcacacaaagcctatttggtggtctcctgacacagacgcgcatga

SEQ ID NO: 55 - DNA, 487 bp, Homo sapiens
gtcaggcttctgagcccaagccaagccatccatcccctgtgacctgcacgtatacgcccagatggcctgaagtaactaaagaatcacaaaagaagtgaatatgccctgacccaccttaactgatgacattccaccacaaaagaagtgtaaatggccggtccggtccttgccttaactgatgacattaccttgtgaaagtccttttcctggctcatcctggctcaaaaagcacccccactgagcaccttgcgacccccactcctgcccactgagcaccttgcgacccccactcctgcccgccagagaacaaaccccctttgactgtaattttcctttacctacccaaatcctataaaacggccccacccttatctcccttccctgactctcttttcggactcagcccgcctgcacccaggtgaaataaacagctttattgctcacacaaagcctgtttggtggtctcttcacacggacgcacatgaaa

SEQ ID NO: 56 - DNA, 4218 bp, Homo sapiens
gtcaggcctctgagcccaagctaagccatcatatcccctgtgacctgcacatacacatccagagggccggttcctgccttaactgatgacattatcttgtgaaattgcttctcctggctcatcctggctcaaaagctccccttctgagcatcttgtgaccccctagtcctgcccacagagaacaaaccccctttttcctttacctacccaaatcctataaaatggccccacccccatctcccttcactgactctgttttcggactcagcccacctgcacccaggtgaaataaacagctttattgctcacacaaagcctgtttggtggtctctttacatggacgcaagtgaaatttggtgccgtgactcggatcgggggaccccccttgggagatcaatccactgtcctcctgctctttgctccgtgagaaagattcacctacgacctcaggtcctcagaacgaccagcccaagaaacatctcaccaatttcaaatctggtaagtggcctctttttactctcttctccaacctccctcactatccctcaacctctttctcctttcaatcttggtgccacacttcaatctctcccttctcttaatttcaattgctttcattttctggtagagacaaaggagacacattttatccgtggacccaaaactccggcgccagtcacggactagggaaggcagccttcccttggtgtttaatcattgcagggatgcctctctgattattcacccaggtttcagaggtgtcagaccatgcagggatgcctgccttggtccttcacccttagtggcaagtcccgcttttctgggggaggggcaagaaccccaaccccttctctccatgtctctaccccttttctgcttttctgggggaggggcaagaacccctcaaccctgtctccttcacccttagtggcaagtcccgcttttctgggggaggggcaagaacccctcaactccttctccttcacccttagcagcaagtcctgtttttctgggggaggggcaggagccccgacctcttatctctgtgccccgatcccttatttccgtgccccgacctcttatctctgtgacccgaccccttatttctgtgccctgaccccttctctgcttttctggagggcaagaacccctcaccccttctccatgtctctactctcttttctctgggcttgcctccttcactataggcaagcttctaccttccattcctccttcttctcccttagcctgtgttcttaagaacttaaaacctcttcaactctcacctgacctaaaatctaagtgtcttattttcttctgagatgctgcttgaccccagtacaaactcgacagtagttccaaatagctggaaaacggcactttaatttttccatcctacaagatctaaataattcttgttgtaaaataggcaaatggtctgagatgcctgacgtccaggcattcttttacacatcagtccttccctagtctctgttcccaatgcaactcatcccaaatcttccttctttctctccctcctgtcccctcagcccaaaccccaagcattgctgagtctttttaatcttccttttctacagacccatctgacctctcacctccccgccaggccgagctaggtcccaattcttcctcaacctctgctcctccaccctataatccttttatcacctcccctcctcacacctggtcaggcttacagttttgttccatggctagccctcccccacctgcctagcaatttactcttaaaatggtggctggaactaaaggcatagtcaaggttaatgctccttttcctttattcccaaatcagatagtgtttaggctctttttcatcaaatataaaaatccagcccagttcatggctcgtttggcagcaaccctgagacacttttcagccctagaccccaaaaggtcaaaaggccgtcttattctcaatatacattttattacccaatctgctcccaacattaaataaaactccaaaaattaaattgtggctctcaaaccccacaacaggacttaattaaccttgccttcaaggtgtacaataatagagtagaggcagccaagtagcaacatatttctgagttgcaattccttgcctccactgtgagacaaaccccagccacacctccagcacacaagaacttccaaacacgcctaaactgcagtggccaggcgttcctccagaaccacttcccccaggagcttgctacaagtgccagaaatctggccaccaggccaaggaatgcccagcagtcctcctaagctgtgtcccaactgtgtgggaccccactggaaattggattgttcaactcacctggcagccactcccagagcccctggaactctggcccaaggctctctgactccttcccagatcttctcggcttagcggctgaagactgatgctgcccaattgcctcggaagccctgtagaccatcacagacaccgagctttaggtagctctcacagtggagggtaagtccttccccttcttaataaatacagagtctacccactccatattaccttcttttcaagggcctgtttcccttgcctccataactgttgtaggtattgacagccaggcttctaaacctcttaaaactccccaactctggtgccaacttagacaatactcttttaagcactcctttttagttatccccacctgcccagttcccttattaggccgagacactttaactaaattatctgcttccctgactattcctggattacagctacatctcattgccgcccttcttcccaatccaaagcctccttttcgtcctcctcttgtatcccccccaccttaacccacaagtataagataccgctactccctccttggcgaccgatcatgcaccccttaccatctgattaaaacctaatcacccttaccccactcaatgccaatatcccatcccacagcatgctttgaaaggattaaagcctgttatcacttgcctgctacagcatggccttttaaagcctataaactctccttacaattcacccattttacctgtcttaaaaccagacaagccttaaaagttagttcaggatctatgccttatcaaccgaattgttttgcctatccaccccatgatgccaaacacatatactctcctatcctcaatacctccctccacaatccattattcggttctggatctcaaacatgctttctttactattcctttgcacccttcatctcagcctctcttcgcttttacttggactgacccagacacccatcaggctcagcaaattacctgggctgtactgctgcaaagcttcacggacagcctccattacttcagtcaagcccaaatttcttccttatctgttacctatctatctcagcataattctcataaaatacacgtgctcttcctgctgatcgtgtctgactaatctctcaaaccccagcaccttctacaaaacaacaactcctttccttcctgggcatggttggacactttcacctttggatacctggttttgccatcctaacaaaaccattatataaactcacaaaaggaaacctagctgaccccatagatcctaaatcctttccccactcctctttccattccttgaagacagctttagagactgccccgaccctggctctccctgactcatcccaacccttttcattacacacagccgaagtgcagggctgtgaagtcggaattcttacacaaggaccgggattgtgtcctgcaggctttttgtccaaacaacttgaccttactgttttaggctggccatcatgtctccgtgcagcagctgctactgccctaatacttttagaggcccttaaaataaaaaactatgcacaactgactctctacagctctcataatttccaaaatctgttttcttcctcacacctgacgcatatactttctgctccctggctccttcagctgtactcactctttgttgagtctcccacaattaccattgttcctggcccggacgtcaatccggcctcccacattattcctgataccacacctgaccctcatgactgcatctctctgatccacctgacattcaccccatttccccacatttccttcttccctgtttctcaccctgatcacacttggtttattgatgacagttccaccaggcctaatcgccacacaccagcaaaggcaggctatgctatagca

SEQ ID NO: 57 - DNA, 6030 bp, Homo sapiens
gtcaggcctctgtgcccaagccaagccattgcatcccctgtgacttgcacgtatatgcccagatggcctgaagtaactgaagaatcacaaaagaagtgaaaatgccctgccccgccttaactgatgacattccaccacaaaagaagtgtaaatggctggtccttgccttaagtgatgacattaccttgtcaaagtctttttcctggctcatcctggctcaaaaaccacccccactgagcaccttgcgacccccactcctgccagccagagaacaaaacccctttgactgtaattttcctttacctgcccaaatcttataaaacggccccacccctatctcccttagctgactctcttttcagactcagcccacctgtacccaggtgaaataaacagctttattgctcatacaaagcctgtttggtggtctcttcacacagacgcgcatgaaatttagtgccgtgactcggatcgggggacctcccttgggagatcaatcccctgtcctcctgttctttgttccgtaagaaagatccacctacaacctcaggttctcagacagactagcccaagaaacatctcaccaatttcaaatccggtaagcggggaagtaccccaaccccttatctccgtgtctctaccccttctccgcctttctggggggcaaaaaaccccccaaccccttcttcttcacccttagaggcaagtcccgcttttctgagggagggacaagtaccccaaccccttatatctctgcgctccaatcccttatttccatgccccgacctcttatatctctgtgccccgatcccttatttccgcaccccagcctcttatatctcggtgccctgatcccttatttctgcgcccccaacctcatatctctgtgcctcgacccctttcccgcttttctggagggtaagaacccccgaacagcttccctctgtgtctctactctcccttttctttcaacttggctccttcactataggcaaccttccaccctccattccttcttcttctcccttagcctgtgttctcaaaaacttaaaacctcttcaactcacacctgacctaaaacctaaatgccctattttcttctgcaatgccacttgaccccaatacagacagtagttccaaatagccagaaaatggcactttcaatttttccatcctgcaagatctaaataattgttgtcataaaataggcaaacggtctgaggtgcctgacgtccaggcattcttttacacattggtcccttcctagtctctgtgcccaatgcaactcataccaaatcttcctcctttccctcctgcctgtcccctcagtcccaaccccaagcgccgctgagtctttctaatcttccttttctacagacccatctgacctctcccctcctcgccaggccgagctaggtcccaattcttcctcagcctccgctcctccaccctataatccttttatcacctcccctcctcacacctggtccagcttacagtttggttccacaactagccctcccccacctgcccagcaatttcctcttaaaaaggtggctggagctaaaggcatagtcaaggttaatactcctttttctttatccaacctctcccaaaacagttagcatttagactcttttacatcaaatataaaaaacccagcccagttcatggatcgttcggcagcaaccctgagacgctttacagccctagaccctaaaaattcaaaaggccatcttattctcaatatacattacccaatctgctcccgacattaaataaaactccaaaaattctagccctcaaactccacaacaggacttaattaacctcaccttcaaggtgtacaataatagaaaaaagttgcaataccttgcctccactgtgagacaaatcccagccacatctccagcacacaagaacttccaaaggcctgaaccgcagtggccaggcattcctccagaacctcgtcccccaggagcttgctacaagtaccagaaatctggccaccaggccaaggaatgcctgcagcccaggattcctcctaagctgcgtcccatctgtgtgggaccccactggaaatcagactgtccaaatcacctggcagccactcccagagcccctgggactctggcccaaggctctctgactgactccttcccagatcttcttggcttagcggctgaagactgatgctgcccgattgcctcagaagccccgtagaccatcacggactccgagcttcgggtaactctcacagtggagggtaagtctgtccccttcttaatcaatactgaggctactcactccacattaccttattttcaagggcctgtttcccttgcctccataactgttgtaggtattgacggccaggcttctaaacctcttaaaactccccaactctggtgccaatttagacaatactctcttaagcactcctttttaattatccccacctgcccagttcccttattaggccgagacactttaactaaattatctgcttccctgacaattcctgggctacagccacacctcattgccaccttttcccgcagttcaaagcctccttcacatcctccctctcgtatccccccccaccttaacccacaagcataggatacctctactccctccttggcgaccgatcatgcaccccttaccatctcattaaaacctaatcacccttaccccactcaacgccaatataccatcccgcagcatgctttaaaaagattaaagcctgctatcactcgcctgctacagcatggccttttaaagcctataaactctccttacaattcccccattttacctgtcctaaaaccagatgagccttacaagttagttcaggatctgccccttaccaaccaaattgttttgcctatccaccctgtggggccaaacccatatactctcctatcctcaatacctccctctacaacccattattctgttctagatctcaaacatgctttctttactattcctttgcacctttcctcccagcctctctttgctttcacttggactgaccctgacacccatcaagctcagcaaattacctaggctgtactgctgcaaagcttcacagacagcccccattacttcagtcaagcccaaatttcttcctcatctgttacctatctcggcataattcgcataaaaacacacgtgctctccctgccaatcgtgtctgactgatctctcaaaccccagcaacttctacaaaacaactcctttccttcccaggcacggttagcgtggtcagaattcttacacaagagccaggacctcaccctgtagcctttctgtccaaacaacttgaccttactgttttagcctagccctcatgtctgtgtgcagcggctgccactgctttaataattttagaggccctcaaaatcacaaacgatgctcaactcactctctacagttctcataacttccaaaatctattttcttcctcatacctgacgcatatactttctgcttcccggctccttcagctgtactcactctttgttgagtctcccacagttactgttgttcctggcccagacttcaatccggcctctcacattattctggataccacacctgaccctcatgactgcatctctctgatccacctgacgttcaccccatttccccacatttccttcttccctgtttctcaccctgatcacacttggtttattgatggcagttccaccaggcttaatcgccactcaccagcaaaggcaggctatactatagtatcttccacatctatcattgaggctaccactctgaccccctccactacccctcagccagctgaactagttgccttaactcaagccctcactcttgcaaaaggactacgcgtcaatatctatactgattctaaatatgcctttcatattctgcaccaccatgcggtcgtatgagctgaaagaggttttctcactacaaaagggtcctccatcattaatgcctctttaataaaaactctactcaagcccgctttacttacaaaggaagctggggtcattcactgcaaggggcgtcaaaaggcgtcagatcccattgctctaggcaacgcttatgctgataaggtggctagacaagcagctagctctccaacttctgtccctcacggccagtttttctccttcacatcggtcactcccacctactcccctgctgaaacttccacctatcaatctcttcccacacaaggcaaatggttcttagaccaaggaaaatatctccttccagcctcacaggcccattctattctgtcgtcatttcattacctcttccatgtaggttacaagccactagcccgtctcttagaacctctcatttcctttccatcatggaaatctatcctcaaggagatcacttctcagtgtgccatctgctattctactacccctcagggattgttcgggcctcctccctttcctacacatcagctctgggatttgcccctgcccaggactggcaaattgactttactcacatgcctcgagtcagaaaactaaaatatctcttagtctgggtagatactttcactggatgggtagaggcctttcctacagggtctgagaaggccaccacagtcatttcttcccttctgtcagacatatttcctcagtttagcctttccacctctatacagtctgataacagaccagcctttattagtcaaatcagccaagcagtttttcaggctcttagtattcagtgaaacctttatatctcttacagtcctcagtcttcaggaaaagtagaacagactaatggtctcttaaaaacacacctcaccaaggtcagccaccaacttaaaaaggactggacaatacttttaccactttcccttctcagaattcaggcctgtcctcggaatgctacaaggtacagcccatttgagctcctgtatagatgctcctttttattaggccccagtctcattccagacaccagaccaacttagactgtgccccaaaaaatttgtcatccctactatcttctgtccagtcatactcctattcaccgttctcaactactcatacatgccctgctcttgtttacactgccggtttacactgtttctccaagccatcacagctgatatctcctggtgctatccccaaactgccactctaaactcttgaagtaaataatctttgctggcaggactacgctgaatctccttaggcactctctaatcagatgtcctgggtcctccaattcttagaccttttatacctgtttttctccttctcttattccattttttagtttttcaattcatacaaaaccgtatccaggccatcaccaataattctacacggcaaatgtttcttctaacaatcccacaatatcacccctcaccacaaaatcttccttcagcttaatctctcccactctaggttcccacgccacccctaaccccgctcaaagcagccctgagaaacatcgcccattctctctctccataccatccccccaaaattttcgccaccccccacacttcaacactattttgttttatttttcttattaatataagaaggcaggaatgtcaggcctctgagcccaagccaagccatcgcatcccctgtgacttgcacgtatatgcccagatggcctgaagtaactgaagaatcacaaaagaagtgaaattgccctgccccgccttaactgatgacattccaccacaaaagaagtgtaaatggccggtccttgccttaagtgatgacattaccttgtcaaagtctttttcctggctcatcctgactcaaaaagctcccccactgagcaccttgtgaccccctactcctgcccaccagagaacaaaccccttttgactgtaattttcctttacctgcccaaatcttataaaacggccccacccctatctcccttcgctgactgtcttttcggattcagcccacctgcacccaggtgaaataaacagctttattgctcacacaaagcctgtttggtggtctcttcacatggacgcccctgaaa

SEQ ID NO: 58 - DNA, 461 bp, Homo sapiens
tagatagtcagatatgtgcagggcaggagaggacccctcctaccagaaatgtctggtgcccatcaggtgatggtcaggtggttgttacactgtctctctaaaatagtattaataattggttgcagccagtgccagggaaaggcagtctcccaatagatagaaacacctgaatctggtgatcagcagcttcctgataagatctcaggagctgagcaaatgggctcaagcatgtgcaccaagaggcaaaatggcagagtttaactggtaggtgacctttctctgggaacactgaacgggaaaaatgcctcaagtgagcatgtgcacaacttcagtaaacacactgcgcattgggcccctctcaagtgctggcagaccactgtgcatgtggacagcccaccccaagggaagaatcaagggagaagagatgcaaccccctaaaagcatgccagtgtataagactc

SEQ ID NO: 59 - DNA, 5739 bp, Homo sapiens
gtcaggcctctgagcccaagccaagccatagcatcccctgtgacttgcacatatacgcccagatggcctgaagtaactgaagaatcacaaaagaagtgaaaaggccctgccccatcttaactgacgacattccaccattgtgatttgttcctgccccaccttaactgagtgattaaccctgtgaatttccttctcctggctcagaagctcccccactgagcaccttgtgacccccgcccctgcccaccagagaacaaccccctttgactgtaattttccattaccttcccaaatcctataaaacggccctacccctacctccctttgctgactcttttcagactcagtccgcctacacccaggtgaaataaacagccatgttgctcacacaaagcctgtttggtggtcttttcacacggacgcgcatgaaatttggtgccgtgactccgattgggggatctcccttgggagatcaatcccctgtcctcctgttctttgctctgtgagaaagatccacctaccacctcaggtcctcagaccgaccagcacaagaaacatctcaccaatttcaaatccggtaagcagactctttttactctcttctccaacctccctatccctcaacctctttctcttttcaatcttggcgccacacttcaatctctcccttctcttaatttcaattcctttcattttctggtagagacaaaggagacaagttttatctgtggacccaaaactctggcgccggtcacggactgggaaggcagccttcccttggtgtttaatcattgcagggacgcctctctgattatacagtcacgtttcaagggtgtcagaccacgcagggacgcctgccttggtccttcacccttagcagcaagtcccgcttttctggggaaggggcaagtatcccaaccccttctctccttgtctctaccccttctctgcttttccggggacgggacatgtaccccaaccccttctctgtctctactccttctctgctatcctggggcaggggcaagtacacctcaaccccttctccttcacccttagcggcaagtcccgctttcctagggggcaagaaccccccaatcgcttatttccacaccccaacctcttatctctgcaccccaatcccttatttccacgccccaatctcttatctctgcaccccaatcccttatttccgtgccccaacactttctctgcttttctggagggcaagaaacccccaccccttctccgtgtctctactcttttctctgggcttgcctccttcactatgggcaagcttccaccttccattcctctttcttctcccttagcctgtattcttaagaacttaaaacctcttcaattctcacctgacctaaaatctaagcgtcttattttcttctgcaatgccgcttgaccccaatacaaactcaacagtagttccaaatagccagaaaacggcactttcaatttttccatcctacaagatctaaataattcttgtcgtaaaatgggcaaatggtctgaggtgcctgacggccaggcattcttttacacatcagtcccttcctagtctctgtgccccgtgcaattcgtcccaaatcttccttctttccctcccacctgtcccctcagtaccaaccccaagcatcgctgagtctttctaatcttccttttctacagacccatctgacctctcccctcctcgacaggccgagctaggtcccaattcttcctcagcctccgctcctccaccctataatcttttttatcgcctcccctcctcacacctgcttcggcttacagtttcattccgtgactagccctcccccacctgcccagcaatttattcttaaaaaggtggctggaactaaaggcatagtcaaggttaatgctcctttttctttatcgcaaatcagaaagcgtttaggctctttttcatcaaatataaaaatccagcccagttcatggctcgtttggcagcaaccctgagacgctttacagccctagaccctaaaaggtcaaaaggccgtcttattctcaatatacattttattacccaatctgctcccaacattaaataaaactccaaaaactggaatctggccctcaaaccccacaacaggacttaattaacctcaccttcaaggtgtgcaataacagaaaaaagatgcaattccttgcctccactgtgagacaaaccccagccacatctccagcacacaagaacttccaaacgcctgaactgtagcagccaggcgtttctccagaacctcctcccccaggaacttgctacacatgccagaaatctggccactgggccaaggaacgcccgcagcccgggattcctcctaagccgcgtcccatctgtgtgggaccccactgaaaatcggactgttcaactcacctggcagccactcccagagctcctggaactctggcccaaggctctctgactgactccttcttggcttaccggctgaagactgacgctgcctgatcacctcagaagccccgtagaccatcacggatgccgagctttaggtaactcacagtggagggtaagtccatccccttcttaatcaatatggaggctacccactccacattaccttcttttcaagggtctgtttcccttgcctccataactgttgtgggtattgacggccaggcttctaaacctcttaaaactcccccactctcgtgccaacttagacaatactcttttatgcactcttttttagttatctccacctgcccagttcccttattaggccgagatattttaaccaaattatctgcttccctgactcttcctagactacagccacatctcattgccgcccttctccccaacccaaagcctccttcgagtcttcctctcatatcccgccaccttaacccacaagtataggacatctctactccttccctggcaaccgatcacatgcccattaccattccattaaaacctaatcacccttaccccgctcaacggcaatatcccatcccacagcacactttgaaaggattaaagcctgttaacactcgcctgctacagcatggccttttaaaccctataaactctccttaccattcccccattttacttgtcttaaaaccagacaaggcttacaagttagttcagaatctgcgccttatcaaccaaattgttttgcctatccaccccgtggtgccaacccatatactctcctatcctcaatagctccctctactacccattattctgttctaatctcaaacatgctttctttactattcctttgcacccttcatcccagcctctctttgctttcacttagactgaccctgacaccgattaggcccagcaaattacctgggctgtactgccacgaggcttcacaaacagcccccattacttcagtgaagcccaaatttcatcctcatctgttacctatctcggcataattctcataaaaacacacgtgctttccctgctgatcatgtccgattaatctcccaaacctcaatcccttacaaaacaacaactcctttccttcctaggcatggttagtgcggtcagaattcttacacaagagccaggaccacaccctgtagcctttctgtccaaacaacttgaccttactgttttagcctagccctcatgtctgcgtgcagaggctgccgctgctttaatacttttggaggccctaaaaatcacaaactatgctcaactcactctctacatgtctcataacttccaaaatctattttcttcctcatacctgacgcatatactttctgctccccagctccttcagctgtactcactctttgttaagtcccacaattaccattgttcctggcccggacttcaatctggctgcccacattattcctgataccacacctgacccccatgactgtatctctctgatccacctgatattcaccccatttccccatatttccttctttcctgttcctcaccctgatcacgcttgatttattgatggcagttccaccaggcctaatcaccacataccagcaaaggcaggctatgctatagtataagccactagcccgcctctcagaacctctcatttcctttccatcgtggaaatctatcctcaaggaaataacttctcagtgttccatctgctattctactactcctcggggattattcaggccccctcccttccctacacatcaagctccaggatttgcccccacccaggactggcaaattagctttactcaacatgcccaagtcaggaaactaaaatacctcttagtctaaatagacactttcactgaataagtaaaggcctttcctacagggtgtgagaaggccaccgtagtcatttcttcccttctgtcagacataattcctcagtttagccttcccacctctatacagtctgataacagaccagcctttattagtcaaatcagccaagcagtttttcaggctcttagtattcagtgaaacctttatatcccttacggtcctccctcttcaagaaaagtagaacggactaaaggtcttttaaaaacacacctcaccaagctcagccaccaacttaaaaaggactggacaatacttttaccgcttctgcttctcagaattcaggcctgtcctcagaatgctacaaggtacagcccatttaagctcctgtatagatgctcctttttattaggccccagtctcattccagacaccggaccaacttagactgtgcccccaaaaaacttgtcatccctactattttctgtctagtcatactcctattctccattctcaactactcatacatgccctgctcttgtttacactgccggtttacactgcttctccaagccatcacagctgatatctcctggtgctatccccaaactgccactcttaactcttgaagtaaataaataatctccgctggcaggaatatgctgaatctcctcaggcactctctaatcagatatcctgagtcgtcccaattcttagaccttttatacctgtttttctccttcttattccatttagtttttcatttcatacaaaaccgtatccaggccatcaccaatcattctatacaacaaatgtttcttataacaaccccacaatatcaccccttaccacgagatctcctttcagcttaatctctcccactctaggttcccacgccgcccctaatcccgcttgaagcagccctgagaaacaccgcccattctctctccataccaccccctaaaaattttcgccgccccaacacttgcaacactattttgttttatttttcttattaatataagaaggcaggaatgtcaggtctctgagcccaagccaagccatcgcatcccctgtgacttgcacgtatatacgcccagatggcctgaagtaactgaagaatcacaaaagaagtgaaaaggccctgccccatcttaactgatgacactccaccattgtgatttgttcctgccccaccttaactgagtgattaaccctgtgaatttccttctcctggctcagaagctcccccactgagcaccttgtgaccccccacccctgcccaccagagaacaaccccctttgactgtaattttccattaccttcccaaatcctataaaatggccccacccctatctccctttgctgactctcttttcggactcagtccgcctgcacccaggtgaaataaacagccatgttgctcacacaaagcctgtttggtggtctcttcacacgcatgaaa

SEQ ID NO: 60 - DNA, 764 bp, Homo sapiens
gagagacaggactagctggatttcctaggccaactaagaatccctaagcctagctgggaaggtgaccactttcacctttaaacacgggcttggaacttagctcacgcttgaccaatcagatagtaaggagagctcactaaaatgctaattaggcaacaacaggaggtaaagaaatagccaatcatctgttgcctgagagcacagcaggagggacagtgatcggatataaacccaggcattcaagccggcaacgacaaccccctttgggtcccctccctttgtgtgggagctctgttttcactctatttcactctattaaatcttgccgctgcactcttctggtctgtgtttgttacggcttgagctgagctttcgctcaccgtccaccactgctgtttgccgccgtcgcagacccaccgctgacttccattcctccggatccggcagggtgtccgctgtgctcctgatccagagaggcacctactgccacttccaatcgggctaaaggcttgccattgttcctgcacggctaagtgcctgggttcatcctaaccgagctgaatactagtcactgggttccacggttctcttccaggacccacggcttctaatagaggtataacactcaccacatggccgaagattccattcattggaatccatgaggccaagaaccccaggtcagagaacacgaagcttgccgccattttggaagtggctcgccaccatcttgggagctctggaagcaaggacccccagtaaca

SEQ ID NO: 61 - DNA, 775 bp, Homo sapiens
gagagacaggactagctggatttcctaggccgactaagaatctaagcctagctgggaaggtgaccacatccacctttaaacatggggcttgcaacttagctcacacccaaccaatcagagagctcactaaaatgctaattaggcaaaaacaggaggtaaagaaatagtcaatcatctattgcctgagagcacagcgggagggacaaggattgggatataaacccaggcattcgagccggcaacggcaaccccctttgggtcccctccctttgtatgggagctctgttttcactctgtttcactctattaaatcttgcaactgcactcttctggtccatgtttgttatggctcgagctgagcttttgctcaccatccaccactgctgtttgccactgtcgcagacctgccgctgactcccatacctccagatccagcagggtgtctgctgtgctcctgatccagtgagactcccattgccactcccgatcgtgctaaaggcttgccattgttcctgcacggctaagtgcctgggtttgtcctaattgagctgaacactagtcactgggttccacggttctctttcatgacccacagcttctaatagagctataacactcatcgcatggcccaagattccattccttggaatccgtgaagccaagaaccccagtcagagaacacgaggcttgccaccaccttggaagcgcctgccaccatgttggaagcagctcgccaccatcttgggagctctgtgagcaaggacccccagtaaca

SEQ ID NO: 62 - DNA, 4131 bp, Homo sapiens
cctttgctgactccttttttggactcagcccgcctacacccaggtaaaataaacagccttgttgctcacacaaagcctgtttggtggtctcttcatagggacgcatgagacatttggtgccgaagacctgggtcagcgggactcctttgggagaccagtcccccatcctcaccctcactctgtgaagagatccacctacgaccttgggtcctcagaccaaccagcctaaggaacatctcacctattttaaatcgggtaagcggcctctttctactctcttctccaacctctctcactatccctcaacctcttttcctttcaatcttggcaccacccttcagtctctcccttctcttaatttcaattcctttcattttctggtagagacaaaggagacacattttatctgtggacccaaaactccggcacaggtcacagactcaggaacacagccttcccttggtgtttaatcattgtggggatgcctgcctgattattcacccacattccgttggtgtctgatctccgtggggatgcctaacttggtcattcacccacattcccttggtggcaagttaattgtagggacaattgctttggctgctcacccacattgcagcccagggctgctcatgtcaccccttctctccgtgtctctaccctctcttttctctccactttcctggggggcaagcaccccccaccccttctctctgtgtctctgccccttttccactttcctggggggcaagaacctcccaccccttctctccgtgtctctgccccttttccattttcctaggggggcaagtaccccccaccccttctctccatgtctctgccccttttccactttcctggggggcaagcacctcccaccccttttccactttcctggggggcaagcacctcccaccccatttccactttcctgcgggggcaagcaccttcttttcaagggcctgtttcccttgcctccataactgttgtgagtattgacagccaggcttctaaacctcttaaaactccccaactctggtgccaacttggacaacattctttaatgaactcctttttagttatcccacctgcccagctcgcttattagttcaaaacattgtaactaaattatctgcttccctgactattcctgggttaaagccacacctcactactgccttttgccccagttcaatgcctcctgcacatcctctccttgtatctccccaccttaatccacaagtgtaggacacctctactccctccttggcgatggatgatgcaccccttaccatcctattaaaatctaatcacccttaccctgctcagtgccaatatcccatcccacagcacgctttaaaaggattaaagcctgttatcacttgcctgttacagcatggccttttaaagcctataaactctccttacaattcccccattttacctgtccaaaaactggacaagtctcacaggttagttcaggatctgcgtttatcaaccaaattgtcttgcctatccaccccatggtgccaaagccatatactctcctatcctcagtacctccctccacaacccctccataacccattattctgttctggatctcaaacatgctttctttactattccttgcacccttcatcccagcctctctttgctttcacttggactgaccctgacacccatcaggctcagcaaattacctgggctgtactgccacaaggcttcacggacagcccccattacttcagtcaagcccaaatttcttcctcatccattacctatctcgacatagttcttcatgaaaacacacgtgctctccctgctgattgtgtctggctaatctcccaaaccccaaccccttctacaaaacaacaactcctttccttcctaggcatggttggatactttcacctttagatacctggttttgccatcctaataaaaccattatataaactcacaaaaccaaacctagctgaccccatagatcctaaatcctttcaccactcctctttctgttccttaaaaacagccctagaagctgcccccacactagctctccctaactcatcccaacccttttcattacacacagccaaagtacagggctgtgcagtcaaaattcttacacaagagctgggactgcaccctgtagcctttctgtccaaacaacttgaccttactctttttggctggcccccacccccatgactgtatctctctgatccacctgacattcactccatttccccgtatttccttctttcatgttcctcaccctgatcacacttggtttattgatggcagttccaccaggcctaaccgccactcaccagcaaaggcaggctatgctatagtatcttccatatctatcactgaggctaccactctgccctcctccactacctctcagcaagccaaattcattgccttaactcgaacactcactcttgcaaaggaattatgcatcaatatttatacagactgtaaatatgccttccatatcctgcaccaccatgctgttatatgggctgaaagaggtttcctcactatgcaagggtcctccatcattaatgcctctttaataaaaactcttctcaaggccgctttacttcccaagaaagctggagtcatacactgcaagggccactaaaagacatcagatcccattgctcagggcaacgcttatgctgataaggtagctaaagaagcacctagtgttccaacttctgtccctcatggccagtttttctccttctaattggtcactcctatttactctcctactgaagtttccacctatcaatctcttcccgcacaaggcaaattgttcttggaccaaggaaaatatctccttccagcctcacatgcccattctattctgttgtcatttcataacctcttccacggtaggttacaagccgttagtctgcctcttcaaacctctcatttcctttccatcgtgaatatctatccccagtcctccactcttgactccctcttggagtggatagatgatctttgctgacaggacacattccaacactttcaccctgatgaagtcctattctttacttttatactcactcttattcttgttcccattcttattgccaccctctacctctccccagctatctccaccacactatcaatttcactcactctctcctagctatttctaatccttctttaacaaacaattgctggctttgcatttctctttcctccaaaatcaccaaggcctcaatttactcactgctgaaaagggaggactctgtatatttttaaatgaagagtgttgtttttaccttaatcaatctggcctggtatatgacaacataaaaaaactcaaggatagagccccaaaactcgtcaactaagaatataattatgctgaacccccttgggcactctctaattggatgtcctgggttctcccaattcttagtcctttaatacttgtttttctccttctcttattcagaagttgtgtctgtcatttagtttctcaattcatacaaaaccacattcaggccatcaccaataattctatatgacaaatgctccttctaacaactccacaatatcaccccttaccccaaaatatttcttcagtttaatctctcccactctaggttctcacaccaccccaatcccacttggagcagccctgagaaacattgcccattatctctccataccaccccaaaaatttttgccacaccaacacttcaccactattttgttttgtttttcttattaatacatgaagacaggaatgtcaggcctctgaacccaagctaagccatcatatcccctgtgacctgcatttatacatccagatggcctgaagcaaatgaagatccacaaaagaagtaaaaatagccttaactgatgacattccaccattgtcatctgccctaccctaactgagaagatatattctcccccgcccttaagaaggtactttgtatgcctatcccaaacctataagaactaatgataatcccagcgccctttgatgactcttttttctgactcagcccacctgtacccaggtgaaataaacagccttgttgctcacacaaagcctgtttggtggtctcttcgcaaggacgcatgaga

SEQ ID NO: 63 - DNA, 5155 bp, Homo sapiens
gacaggcctctgagcccaagccaagccatcgcatcccctgtgacttgcacgtatacgcccagatggcctgaagtaactgaagaatcacaaaagaagtgaatatgccctgccccaccttaactgatgacattccaccacaaaagaagtataaatggtcggtccttgccttaactgatgacattaccttgtgaaagtccttttcccggctcatcctggctcaaaaagcacccccaccgagcaccttgcgacccccactcctgcccgccagagaacaaaccccctttgactgtaattttcctttacctacccgaatcctataaaacggccccacccttatctcccttcgctgactctcttttcggactcagcccgcctgcacccaggtgaaatacacagccatgttgctcacacgaagcctgtttgttggtctcttcacacagacgcgcatgaaatttggtgctgtgactcggattgggggacctcccttgggagatcaatcccctgtactcctgttctttgctccgtgagaaagatccacctatgatctcaggtcctcagaccgaccagcccaaggaacatctcaccaattttaaatcaggtaagcggcctcttcttactctcttctccaacctctctcactgtccctcaaccactttctcctttccactcttcaatctctcccttctcttaatttcaattcctttcattttctggtagagacaaaggagacacgttttatccgtggacccaaaactccggcgccagtcacggactgggaaggcagccttcccttggtgtttaatcagtgcagggacgcctctctgattatacacccacgtttcaagggtgtcagaccacgcagggacgcctgccttggtccttcaacctcagcggcaagtcccgcttttctggggtaggggcaagtagctcaaccccttctctccttgtctctaccccttctctgcttttctgggagaggggcaagtacccctcaaccccttctccttcacccttagcggcaagtcccgctttcctagggggcaagaagcccccaatagcttatttccgcaccccaacctcttatctctgtgccccaatcccttatttccgcaccctgacctcttatctctgtgccccaatcccttatttccgtgccccaactccttctctgcttttctggagggcaagaaccccccaccccttctccgtgtctctactcttctctgggcttgcctccttcactatgggtaagcttccaccttccattcctccttcttctcccttagcctgtgttctcaaaaacttaaaacctcttcaactcacacctgacctaaaacctaaatgccttattttcttctgcaatgccgcttgaccccaatacaaactcgacagtagttccaaatagccagaaaatggcactttgaatttttccatcctgcaaaatctaaataattcttgtcataaaataggcaaacgatctgaggtgcctgacgtccaggcattcttttacacatcagtcccgtcctagtctctgtgcccagtgcaactcgtcccaaatcttccttctttccctcccgcctgtcccctcagtaccaaccccaagcgtcgctgaatctttctaatcttccttttctacagacccacctgacctctcccttcctcccaggctgctcctcgccaggccgagctaggtcccaattcttcctcagcctctgctcctccaccctataatccttttatcacctcccctcctcacacctggtccggcttacagtttcgttccgtgactagccctcccccacctgcccagcaatttactcttaaaaaggtggctggagctaaaggcatagtcaaggttaatgctcctttctctttatcccaaatcagaagcgtttaggctctttttcatcaaatataaaaatccagcccagttcatggctcgttcggcagcaaccctgagacactttacagccctagaccctaaaaggtcaaaaggccgtcttattctcaaaatacattttattacccaatctgctcccaacattaaataaaactccaaaaattaaattccggccctcaaaccccacaacaggatttaattaacctcgccttcaaggtgtaccataatagaaaaaagttgcaattccttgcctccactgtgagacaaaccccagccacatctccagcacacaagaacttccaaacgcctgaaccgcagcggccaggtgttcccccagaacctcctcccccaggagcttgctacacgtgccggaaatctggccactgggccaaggaatgcccgcagcccgggattcctcctaagccgcgtcccatctgtgcgggaccccactggaaatcggactgttcgactcacctggcagccactcccagagcccctggaactctggcccaaggctctctgactgactccttcccagatcttctcggcttagcggctgaagactgacgctgcccgatcgcctcagaagccccctagaccatcaccgacgctgagcttcgggtaactctcacagtggaaggtaagcccgtccccttcttaatcaatacggaggctgagtagcctccacattaccctcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggctgagacactttaactaaattatctgcttccctgactattcctggactacagctgtatctcattgccgcccttcctcccaatccaaagcctcctttgcgtcctcctcttgtatccccccaccttaacccacaagtataagatacctctactccctccttggcgaccgatcatgcaccccttaccatctcattaaaacctaatcactcttaccccactcaacttaaagtgccaatatcccatcccgcagcatgctttaaaaagattaaagcctgttatcactcgcgtgctacagcatggcgttttaaagcctacaaactctccttacaattcccccattttacctgtcctaaaaccagacaagccttacaagttagttcaggatctgcgccttatcaaccacattgttttgttgcctatccaccccatggtgccaaacccatatactctcctatcctcaatacctgcctctacaacccattattctgttctggatctcaaacatgctttctttactattcctttgcacccgtcatcccagcctctcttcgctttcacttggactgaccctgacacccatcaagctcagcaaattacctaggctgtacagccgcaaagcttcacagacagcccccattacttgaatcaagcccaaatttctttttcatctgttacctatctcggcataattctcataaaagcacacgtgctctccctgccaatcgtgtccgactgatctctcaaacccaagcaccttctacaaaacaactcctttccttcctaggcatggttagctcagtcagaattctcacacaagagccaggaccacaccctgtagcctttctgtccaaacaacttgaccttactgttttagcctagccctcatgtctgcgtgcagtggctgccgctgctttaatacttttagaggccctcaaaataggtagaggcctttcctgcagggtctgagaaggccaccgcagtcatttcttccattctgtcagacataattcctcagtttagccttcccacctcaatacagtctgataacagacgagcctttattagtcaaatcagccaagcagtttttcaggctcttagtattcagtgaaagctttatatcccttacggtcctccgtcttcaagaaaagtagaatggactaaaggtcttttaaaaacacacctcaccaagctcagccaccaacttaaaaaggactggacaatacttttaccactttcccttctcagaattcaggcctatcctcagaatgctacagggtacagcccatttaagctcctgtatagacgctcctttttattaggccccagtctcattccagacaccagaccaacttagactgtgcctcaaagaaaaaaaaaaattgtcatccctactattttctgtctggtcatactcctattcaccgttctcaactactcatacatgccctgctcttgtttacactgccagtttacactgtttttccaagccatcacagctgatatctcctggtgctatccccaaactgccactcttaactcttgaagtaaataaatcatctttgctggcaggactatgctgaatctccttaggcactctctaatcagacatcctgagtcgtcccaattcttagaccttttatacctgtttttctccttctgttattccatttagtttttcaattcatacaaaaccgtatccaggccatcaccaatcattctatatgacaaatgtttcttctaacatccccacaatctcaccccttaccacaagacctcccttcagcttaatctctcccactctaggttcccacgccgcccctaatcccgcttgaagcagccctgagaaacatcgcccattctctctccataccaccccccaaaaatgttcgctgccccaacacttcaacactattttgttttatttttcttattaatataagaaggcaggaatgtcaggcctctgagcccaagccaagccatcgcatcccctgtgacttgcacgtacacgcccagatggcctgaagtaactgaagaatcacaaaagtgaatatgccctgccccaccttaactgatgacattccaccacaaaagaagtgtaaatggccggtccttgccttaactgatgacattaccttgtgaaagtccttttcccggctcatcctggctcaaaaagcacccccactgagcaccttgcgaccccccactcctgcccgccagagaacaaaccccctttgactgtaattttcctttacctacccgaatcctataaaacggccccacccttatctcccttcgcggactctcttttcggactcagcccgcctgcacccaggtgaaatacacagccatgttgctcacacaaagcctgtttggtggtctcttcacacggacgcacatgaaa

SEQ ID NO: 64 - DNA, 6149 bp, Homo sapiens
gttaggcctctgagcccaagcctgcacgtatacgtccagatggcctgaagcaagtgaagaatcacaaaagaagtgaaaatggctggttcctcccttaactggtgacattaccttgtgaaattccttctcctggctcatcctggctcaaaagctcccccactgagcaccttgtgacccccaccccagccagccagagaacaaccccctttgactgtaattttccactacctacccaaatcctgtaaaacagccccacccctgtctcccttctctgactctcttttcggacacagcccgccggcagccaggtgattagaaagctttattgctcacacaaagcctgtttggtggtctcttcatacagacgcatctgaaatttggtgccatgactcgaatcgggggacctcccttggaagatcaatcccctgtcctcctgctctttactccatgagaaagatccacctacaacctctggtcctcaggccaaccagcccaaggaacatctcaccaattttatatccggtaagcagcctctctttactctcttctccaacctctctcactatccctcaacctctttctcctttcaatcttggtgccacacttcaatttctcccttctcttattttcagtttctttccttttctggtagagacagaggagatgcgttttatccgtgaacccaaaacgccggctccagtcacggactcggaaagaaagtcttcccttggtgtttaattactgtggggacgcctgcttgattattcacccacatttcagaggtgtctgatcaccatggggacgcctgccttgatccttcacccttagtggcaagcaccactttttgggggtcaagcaccccccaccctttctctctgtgtctctaccctctcttttctctctactttcctggggggcaagcaccccccaccccttctccactttcctggggggcaagcatcccccaccccttctctccatgtctctaccttctcttttctctggacttgcctccttcactataggcaggcttccaccctccattcctccttcttctcccttagcctgtgttctcaagaacttaaaacctcttcaactcacacctgacctaaaacctaaatgccttattttcttctgcaatgctgcttaaccccagtacaaactcgacagtggttccaaatagcaagaaaacggcactttcgatttttccatcctacaagatctagataattcttgtcataaaatgggcaaacggtctgaggtgcctgacatacaggcattcttttacacatcggtccgtccctagtctctgttcccaatgcagctcctcccaaatcttccttctttccctcctgcctgtcccctcagtcccaaccccaagtgttgctgagtctttccaatcttccttttttatggacccatctgacctctgccctcctccccaggctgctcctcaccaggccaagccaggtcccaattcttcctcagctctgctcccccactctataatcttttgatcacctcccctcctcacacccagtccagcttacagtttcgttatgtgccctcccccaccagcccagcaatttcctcttaaaatggtagctggaactacaggcatagtcaaggttaatgctcctttttctttatccaacctctccaaaatcagttagcgtttaggctctttttcatcaaatataaaaacccagcccagttcatggctcatctggcagcaaccctgagacgctttacagccctagaccctaaaaggtcaagggccgtcttattctcaatatacatgttattacccaatccgctcccaacattaaataaaactccaaaaattaaattccagccctcaaaccccacaacaggacttaattaacctcaccttcaaggtgtacaataatagagtagaggcagccaagtagcaacatatttctgagttgcaattccttgcctccagtgtgggagaaaccccagccacatctccagcacacaggaacttccaaacacataaaccgcagtggccaggcattcctccaggaccacctccaccaggaacttgcttcaagtgctggaaatctggccactgggccaaggaatgcccacagcccaggattcctcctaagctgtgccccatctgtgcaggtacccactggaaattggactctccaactcacccggcagccactcccagagccactggaactctggcccaacgctctctgactgactccttcccagatcatctcagcttagcggctgaagattgatgctgcccaatcacctcagaagcttcctggaccatcacatacgctttgggtaactcttacagtggagggtaagtccgtccccttcttaatcaatacggaggctacccactccacattaccttcttttcaagggcctatttcccttgccccatgactgttatggttattgatggccaggcttctaaacctcttaaaactccccaactctggtgccaacttggacaatattcttttatgcactcctttttagttatccccacctgcccagttcccttattaggctgagacattttaactaaattatctgcttccctgactattcctaggctacagccacacctcattgccacccttttccccagttcaaacactccttcacatcctccccttgtatctcaccaccttaatccacaagtataggacacctctactccatccatggtgaccgatcatgcaccccttatcattccattaaaacctaatcacccttacccaactcaacgccaatatcccatcccacagcagcctttaaaaggagtaaagcctgttatcacttgcctgttacagtgtggccttttaaagcctataaactctccttacaatccccccattttacctatccaaaaaccagacaagtcttacaggttagttcaggatctgcaccttatcaaccaaattatcttgcctatccaccccatggtgccaaacccatatactctcctatcctcaatacctccctccacaacccattattctgttctgtgtggcaaacatgctttctttactattcctttgcacccttcatcccagcctgtcttcgctttcacttggactgaccctgacaccatcaggctcggcaaattacctgggctgtactgccacaaggcttcacagacagcccccattacttcagtcaagcccgaatttcttaatctgttacctatctcggcataattcttcataaaaacacaggtgctctccctgccgatcctgtccaactgatctctcaaaccccaaccccttctacaaaacaacaactcctttccttcctgggcatggttggatacttttacctttggatacctggttttgccatcctaacaaaaccattatgtaaactcacaaaagaaaacctagctgatgccatagatcctaaatccttttcccactcctctttccgttccttgaagacagcattagagaatgcttccacactagctctccctgactcatcccaaccctttttcattacacacagccgaagtgcagggctgtgtggtcgaaattcttacacaaggactgggaccgctccctgtggcctttttatccaaacaacttgagcttactgttttagcctagccctcatgtctgcatgcggcagctgcctctgttttaatacttttagaggccctcaaaatcacaaactgtgctcaactcactctctacagttctcataacttccaaaatctattttcttcctcacaccagatgcacatactttctgcccccctccactacctctcagcaagccgaactcattgccttaactagagccctcactcttgcaaaaggactacgcatcaatatttatactgactctaaatatgccttctatattctgcaccaccatgctgttataagggcagaaagaggtttcctcactacgcaagggtcctccatcattaattcctctttaataaaaactcttctcaaggctgctttacttccaaaggaagctggagtcattcactgcaagggccgtcaaaaggcgtcagatcccatcgctcagggcaacgcttatgctgataaggtagctaaaaaagcagctagagtacaacttcgtccctcaaggccagtttttctccttctcatcggtcactcctacctactcccctactgaaacttccacctatcaatctcttcccacacaaggcaaatggttcttgaaccaaggaaaatatctccttcctggtgggtgcctgtaatcccagctactcaggaggctgagacaggagaatcccttgaactcagtaggctgaggttgcagtgagccaagatcatgccactgcactccagcatgggttacaggagcaagactctgtctcaaaaaaataaataaataaaataaaatctctcttatttaaaaaaaaaaaaacaaaaagaaaaaaaaagaaaatatctccttccagcctcacaggccgattctattctgtcgtcatttcatagcctcttccatgtaggttacaagccactagcccgcctcttagaacctctcatttcctttccaccgtggaaatctatcctcaaggaaatcacttctcagtgttccatctgctattctactactcctcagggattgttcaggccccctcccttccctacacatcaagctcggggatttgcccctgcccaggactggcaaattgactttactcacatgcctcgagtcaggaaactaaaatacctcttggtctgggtgggtagaggcctttcccacagggtctgaaaaggctactgcggtcatttcttcctttctgtaagacataattccttggtttggccttcccacctctatacagtccaataacggaccggcctttactagttaaatcacccaagcagtttctcaggctcttggtattcagtgaaaccctcatacctcttaccatcctcaatcttcagaaaaggtagaatggactaatggtcttttaaaaacgcacctcaccaagctcagccaccaactaaaaaatgactagacaatacttttaccactttcccttctcaaaattcgggcctgtcctcggaatgctacaggttacagcccatttgagctcctgtatagacactcctttttattaggcccccgtctcattccagacaccagcccaacttgggctgtgccccaaaaacttgtcatccctactatcttctgtctagtcataatcctattcaccgttctcaactactcatacatgccctgctcttgtttacactgccggtttacactgtttctccaagccatcacagctgatatctcctggtgctatccccaaaccgcccaccactcttaactccctcttaaagtaaataaataatctttactggcagggctatgctgaacctccttgggcactctctaattggatgtcctgggtcctcccaattgttagtcctttaatacctgtttttctcctcttattcggaccttgtgtcttccgtttagtttttcaattcatacaaaaccgcacccaggccatcaccaatcattctatacaacaagtgtttcttctaacaaccccacaatatcaccccttatcacaaaatcttccttcagcttaatctctcccactctaggttcccacgcctcccctaatcccgcttgaagcagccctgagaaacatcgcccattatatctccataccaccccccaaaagttattgctgccccaacacttcaacactattttattttatttttcttatcaatataagaagacaggaatgtcagatctctgagcccaagcctgcatatatacatccagatggcctgaagcaagtaaagaatcacaaaagaagtgaaaatggccagttcctgccttaactggtgacattaccttgtgaaattccttctcctggctcatcctgactcaaaagctcccccactgagcaccttgtgacccccaccccagccagccagagaacaaccccctttgactgtaattttccactacctaccaaaatcctataaaacagccccacccctatctcccttatctgactcttttcggattcagcctgcctgcacccaggtgattaaaaagctttattgctcacacaaagcctgtttggtgatttcacatggacgcgcatgaaa

SEQ ID NO: 65 - DNA, 772 bp, Homo sapiens
agcgacaggactagctggaattcctaggccgactaagaattcctaagcctagctgggaaagctgatcacacctacttttgaacacggggcttgtaactcagctcacacccaaccaatcaggtaataaagagggctctctaaaatacaaattaggctaaagcaggaggtaaagaaatagtcaaatcacatatcgcctgagagcgcagggggagggacaatgatcagactataaacccaggcattcgaacagggagtgggcaaccccctttgggtcccctcccattgtatgggagctctgttttcactctattaaatgttgcaactgcatactcttctggtccgtgtttgttatggctcaagctgagctttcactcactgtccaccactgttgtttgcccacatcgcagacccgccgctgacttccacccctctggatccggcagggtgtccgctgtccatggaggcacccattactgctcccgatccggctaaaggctcgccattgtttctgcacggctaagtgcccaggttcgtcccaatcgagctgaacactggtctctaggttccacggttctcttctgtgacccacggcttctaatagagctgtaacactcaccgcatggcccaaagttccattccttggaatccatgaagccaagaaccccaggtaagagaacaaaaggcttgccgccatctttggagcggccgccccatcttgggcgtggcctgccaccatcttgggagctctaagaacaaagacccgcccataaca

SEQ ID NO: 66 - DNA, 968 bp, Homo sapiens
gtggggaaaagtgagagaaatcagattgttactgtgtctgtgtagaaagtagacatgagactccattttgttctgtactaagaaaaattcttctgccttgagatgctgttaatctgtaaccctacccccaaccctgtgctccctgagacgtgtgctgtgtcaactcagggttaaatggattaagggttgtgcaagatgtgctttgttaaacagatgcttgaaggcagcatgctccttaagagtcatcaccactccctaatctcaagtacccagagatgcaaaacactgtggaagaccgcagggacctctgcctaggaaagccaggtattgtccaaggtttctccccatgtgataacctgagatatggcctcatgggaagggaaagacctgaccatcccccagcccaacacccataaagggtctgtgctggggaagattagtgaaagaggaagacctctttgcagttgagataagaggaaggcctctgtctcctgctcatccatgggcaatggaatgtctcagtgtaaagtccaattgtatattccatctactgagataggggaaaactgccttagggctggaggtgagacatgctggcagcagtactgctctttaatgcattgagatgtttatgtatatgcacatcaaaagcacagcacttttttctttaccttgtttatgatgcagagacctttgttcacgcgttttcttactgaccttctctccactattaccctattgtcttgccacatccccctctctgggaaatgcccgataatgatcaataaatactaagggaactcagaggccacggcaggcaggcgcggttcccccttatgctgaacgctggtcccctgggctgatttttttttctctatactttttctctgtgtctctttcttttccaagtctctcattccacctaacgagaaacacccacaggtgtggaggggcaacccagcccttca

SEQ ID NO: 67 - DNA, 3720 bp, Homo sapiens
gtcaggcctctgagcccaagccaagccatcgcatcccctgtgacttgcaggtatctgcccagatggcctgaagtaactgaagaatcacaaaagaagtgaatatgccctgccccaccttaactgatgacattccaccacaaaagaagtataaatggccggtccttgccttaagtgatgacactaccttgtgaaagtccttttcctggctcatcctggctcagaagctcccccactgagcaccttgtgacccccacccctgcccaccagagaacaaccccctttgactgtaattttccattaccttcccaaatcctataaaacagccccacccctatctcccttggctgactctcttttcggactcagcccacctgcacccaggtgaaataaacagccatgttgctcacacaaagcctgtttggtggtctcttcacacggacgcgcatgaaatttggtgccgtgactcggatcgggggacctcccttgggagatcaatcccccatcctcctgctctttgctccatgagaaaaatccacctatgaccttaggtcctcagaccgaccagcccaagaaacatctcaccaatttcaaatccggtaagcggcctctttttactctcttctccaacctccctcactatccctcaacctctttctcctttcaatcttggcaccacacttcaatctctcccttctcttaatttcaattcctttcattttctggtagagacaaaggagacacgttttatccgtggacccaaaactccggcgctggccacagactgggaaggcagccttcccttggtgtttaatcattgcagggacacctctctgattattcactcacgtttcaagggtgtcagaccacgcagggacgcctgccttggtccttcacccttagcggcaagtcccgcttttctggggaaggggcaagtaccccaaccccttctctccttgtctctaccccttctctgctcttctgggggaggggcaagtacccctcaaccccttctccttcatccttagtggcaagtcccgctttcctggggcaggggcaagtacccctcaaccccttctccttcacccttagcggcaagtcccgctttcctagggggcaaaaaacccccaatcgcttatttctgcaccctgacctcttatctctgtgccctaatcccttatttccgtgccccaaccccttctctgcttttctggagggcaagaacccccccaccccttctccatgtctctactcttttctctgggcttgcctccttcactatgggcaagcttccaccttccattcctccttcttctcccttagcctgtgttctcaaaaacttaaaacctcttcaactcacacctgacctaaaatctaaatgacttattttcttctgcaatgccgcttgaccccaatacaaaccgacagtagttccaaatagccagaaaatggcactttgaatttttccatcctgcaagatctaaataattcttgttgtaaaataggcaaacggtctgaggtgcctgacgtccaggcattcttttacacatcagtcccttcctagtctctgtgcccagtgcaactcgtcccaaatcttccttctttccctcccgcctgtccccccagtcccaaccccaagcgtcgctgagtctttctaatcttccttttctacagacccgtctgacctctcccctcctcgccaggccgagctaggcctcaattcttcctcagcctctgctcctccaccctataatctttttatcgcctcccctcctcacacctggtcctgcttacagtttcgttccgtgactagccctcccccacctgcccagcaatttactcttaaaaaggtggctggagctaaaggcatagtcaaggttaatgctcctttttctttatcccaaatcagatagcatttaggctctttttcatcaaatataaaaatccagcccagttcatgacgtgtttggcagcaaccctgagacactttacagccctagaccctaaaaggtcaaaaggccatcttattctcaaaatacattttattagccaatctgctcccgacattaaataaaactccaaaaattagattccggccctcaaaccccacaacaggatttaattaacctcgccttcaaggtgtacaataatagaaaaaagttgcaattccttgcctccactgtgagacaaaccccagccacatctccagcacacaagaacttccaaacgcctgaaccgcagcagccaggcgttcctccagaacctcctcccacaggagcttgctacacgtgccggaaatctggccactgggccaaggaatgcccgcagcccgggattcctcctaagccgcgtcccatctctctgggaccccactgaaaatcggactgttcaactcacctggcagccactcccagagcccctggaactctggcccaaggctctctgactgactccttcccagatcttctcggcttagcggctgaagactgacactgcccgatcgcctcggaagccccctagaccatcacagacgccgagcttccggtaactctcacagtgcaaggtaggcccgtccccttcttaatcaatacggaggctactcactccccattaccttcttttcaagggcctgtttcccttgcctccataactgttgtgggtattgacggtcaggcttctaaacctcttaaaactccccaactctggtgccaacttagacaatactcttttaagcactcctttttagttatccccacctgcccagttcccgtattaggctgagacactttaactaaattatctgcttccctgactattcctggactacagctatatctcattgccgcccttcttcccaatccaaagcctcctttgcgtcctcctcttgtatcccccgaccttaacccacaagtataagatacctctactccctccttggtgaccgatcatgcaccccttaccatctcattaaaacctaatcacccttaccccactcaacgccaatatcccgtcctgcagcatgctttaaaaagattaaagcctgttatcactcacctgctacagcatggccttttaaagcctataaactctccttacaattcccccgttttacctgtcagccctgagaaacatcgcccattctccctccataccaccccccaaaaattttcaccgctccaacacttcaacactattttgttttatttttcttattaatataagaaggcaggaatgtcaggcctctgagcccaagccaagccatcgcatcccctgtgacttgcacatatacgcccagatggcctgaagtaactgaagaatcacaaaagaagtgaaaaggccctgccctgccttaactgatgacattccaccattgtgatttgttcctgccccaccttaactgagtgattaaccctgtgaatttccttctcctggctcagaagctgccccaccttaactgagtgattaaccctgcgaatttccttctcctggctcagaagctcccccactgagcaccttgtgacccccgcccctgcccaccagagagcaaccccctttgactgtaattttccattaccttcccaaatcctataaaacggccccacccctatctcccttggctgactctctttgcggactcagcccgcctgcacccaggtgaaataaacagccatgttgctcacacaaagcctgtttggtggtctcttcacacagacgcgcatgaaa

SEQ ID NO: 68 - DNA, 6968 bp, Homo sapiens
cctctttgggtcccctccctttctatgggagctctgttttcactctattaaatcttgcaactgtactcttctggtctgtgtttgttatggctggagctgagttttcgctcgctgtccaccactgctgtttgctgccatcgcagacccgctgctgacttccatccctctcaatccggcagagtgtccgctgtgctcctgatccagcaagttgcccattgccgttcctgatcgggctaaaggcttgccattgttcctgcacggctaagcgcccgggtgcgtcctaatcgagctcaatactagtcactgggttctgtgggttctcttccgtgacccacggcttctaatagagctctaacactcaccacatggctcaagattccattccttggaatccatgaggccaagaacccaaggtcagagaacacgaggcttgccaccatcttggaagcggcccaccaccatcctgggagccctgggagcaaggacccccagtaacattttggcgaccacgaagggacctccaaagcagtgagtaatattggaccacttttgcttgctattctgtcctatctttccttagaattggaggaaaatactgggcacctgtcggccagttaaaaatgattagcatggctgccagacttaagactcaggtgtgaggctgtctgggaaagggctttctaacaactcccaacccttctgggttgggagcattcgtctgcctagaaccagcttccgctttcaattttcttggggaagccaagggccgactagagtaagaaagctgtcgtcccgaactcccggctttagccagttgagatcatggcacagccagaagtctctattcaacagtcgcccatgcgtgcacccctacctttccttctaacccatacctcctgggtcccgaccacgactttcttgaaagtgtagcccccaaattcttcttacctctgaatctacttcctctgatccctgcctcctaggtactaatgattcagactttcatttcctctagcaagttgtatctccaaagggatctaaggaagctctacgctgctgcgtccttaggcatctaggctataaacccagggagtcttgtccctggtgtcttgtccctcccaatttaggcatacagctctcgacatgggcagttatgtaggatccgttccccatcacccttgccagggccccaagtttgtaaatggctaagagaaaagagacagagaggagagagacagaggcagagaggagagaaacaggcagagaggcgaaagagacagaggagaaaaagagagtcgaagagagaaagagaaagatagaaatagtaaaaaaccagtgtgccctattcctttaaaagccagggtaaatttaaaacctataattgataattgaaggtcttctccgtgaccctataacactccaatactaccttgttgtcagtgcaaacaagggtgtagcctaaaaatactgagaccactgacaacccttagccttcctatcaaaaatccttaacccagtaacccacggacggcccagaggcattcagcctgtagtggcaactgctttgctaacagaagtaggaaagtaacttttagaggaaacctcattgtgagcacacctcaccagttcagaattattctaagtcaaaaaagcaaaaaggtagcttactaactcaaaaatcttaaagtatggggctattctgttagaaaaaggtaatttaacaccactgatagttcacttaacccagcagatttccttacaggggatttaaatcttaattaccatacaaaggaccaaccagacctaggaggaactcccttcaggacaatagaaggttccttccaggtgattgaggaaaaagccacaatgggtattcagtaattgatagcgaggatcttgtggaagcagagttagaaaaattgcctaataattggtctcctcaaacgtgagagctgtttgcactcagccaagccttaaagtacttacagaatcaaaaagactatctcaatcctgactctaaaggttacctacaccctctctgaaacgaatttgcataagaactatttatgggaatgcatcttgatggggcagctgggttgttatgaaatactcaggaacccagcccagctctaggactcacccctgagcacaaaggcaacgttgggcacactggtaaaggactagaatccagcactctggacccctttctttgtggtcaagaaaggtgagaaaacaggtgcaggactgctacatcggtgagtgtaactaaaccgataaacagaggtccatgggtggtgacgcaccctggaaaggaataagcattaggaccataaaggacgctctaggactaatgctcattggaaaatgagtaggggtgctggcatccctgttctttttccagaagagaaatgttctctccaaggcaaaaatgcccttaagatgtattctggagaactgggaccaatttgaccctcagacgctatgacttatattcttctgcagtactgcctggccatgatatcctcttcaagggggagaaacctggcctcctgagggaagtataaattataacaccatcttacagctagatctcttttgtagaaaagaaggcaaattgagtgaagtgccatatgtacaaactttcttttcattaagagacaactcgcaattatgtaaaaagtgtgatttatgccctacaggaagccctcagagtctacctccctaccccagcgtccccccgactccttccccaactaataaggaccccctttcaacccaaacggtacaaaaggagatagacaaaggggtaaacaacaaaccaaagagtgccaatattccccgattatgcccactccaagcagtgggaggaggagaatttggtccagccagagtgcatgtacctttttctctctcagacttaatagacctaggtaaattctcatataaccctgatggctatactgatgctttacaagggttaggacaatcctttgatctgatatggagagatataatgttactgctaaatcagacactaaccccaaatgagagaagtgctgccataactgcagcccaagagtttggcaatctctggtatttcagttaggtcaatgataggatgacaacagaggaaagagaacaattccccacaggccagcaggcagttcccagtgtagaccctcattgggacacagaatcagaacatggagattggtgccacagacatttgctaacttgcgtgctagaaggactaaggaaaactaggaagaagcctatgaattattcactgatgtccactataacacagggaaaggaagaaaatcctaccgcctttctggagagactaagggaggcattgagaaagcatacctctctgtcacctgactctattgaaggccaactaatcttaaaggataagtttatcactcagtcagctgcagacattagaaaaaacttcaaagtctgccttacgcccagagcaaaacttagaaaccctattgaacttggcaacttcggtttttttataatagaaatcaggaggagcaggcagaacgggacaaacgggacaaaaaaaaaaggccaccactttagtcatggccctcaggcaagcggactttggagactctggaaaagggaaaagctgggcaaattgaatgcctaatagggcttgcttccagtgtggcctacgaggacactttaaaaaagattgtccaagtagaaataagctgcccccttgtccataccccttatgtcaagggaatcactggaaggccaattgccccaggggatgaaggtcctctgagtcagaagccactaaccagatggatccagcagcaggactgaaggtgcccagggaagtgccagcccatgccatcaccttcacagagccccgggtatgcttgaccattaagggccaggaggttaactgtctcctggacactggtgtggccttctcagtcttactctcctgtcccggacaactgtcctccagatctgtcactatccgaggggtcctaggacagccagtcactagatacttctcccagccactaagttgtaactagggaattttactcttttcacatgcttttctaattatgcctgaaagccccactcccttgttagggagagacattctagcaaaagcaggggccattacacacctgaacataggagaaggaacacccgtttgttgtcccgtgcttgaggaaggaattaatcctgaagtctgggcaacaggaggacaatatggacaaggaaagaatgcccatcctgttcaaattaaactaaaggattctgcctccctccccctaaaggcagtacccacttagaaccaaggcccaacaaggactcaaaaaaattgttaaggacctaaaagcccaaggtctagtaaaaccatgcaacagccctgcaatactccaattttaggagcacagaaacccagtggacagtggaggttagtgcaagatctcaggattatcaatgaggccgttgtccctctatacccagctgtacctaacccttatactctgctttcccaaataccagaggaagcagagtggtttacagtcctggaccttaaggatgtctttttctgcatccctgtacatcctgactctcaattcttgtttgcctttgaagatcctttgaacccaatgtctcaactcacctgcactgttttaccccaagggttcagggatagcccccatctatttggccaggcattagcccaagacttgagtcagttatcatacctggacactcttgtccttcagtatgtggatgatttacttttagctgcctgttcagaaaccttgtgccatcaagccacccaagcactcttaaatttcctcgccacctgtggctacaaggtttccaaagagaaggctcagctctgctcacagcaggttaaatacttaggactaaaattatccaaaggcaccaaggccctcagtgaggaatgtatccagcctatactggcttatcctcatctcaaaaccctaaagcaactaagagagttccttggcataacaggcttctgccgaatatggattcccaggtatggcaaaatagccaggccattatatacagtaattaaggaaactcagaaagccaatacccatttagtaagatggatacctgaagcaaaagtggctttccaggccctaaagaaggccttaacccaagtcccagtgttaagcttgccaacggggcaagacttttctttatacatcacagaaaaaaacagaaacagctctgggagtccttacacaggtccaagggacaagcttgcaacccatggcatacctgagtaaggaaactgatgtagtggcaaagggttggcctcattgtttatgggtagtggtggcagtagcagttttagtatctgaagcagttaaaataatacagggagagatcttactgtgtggacatctcatgaggtgaacagcatactcactgctaaaggagacttgtggctgtcagacaaccgtttacttaaatatcaggctctattacttgaaaggccagtgctgcaactgtgcacttgtgcaactcttaacccagtcacatttcttccagacaatgaagatagaatataactgtcaacaaataatttctcaaacctatgccactcgaggggaccttctagaggttcccttgactgatcctgacctcaacttgtatactgatggaagttcctttgtagaaaaaggacctcaaaaagcggggtatgcagtggtcagtgataatggaatatttgaaagtaatcccctcactccaggaactagtgcttagctggcagaactaatagccctcattggggcactagaattaggagaaggaaaagggtaaatatatatacagactctgagtatgctcacctagtcctccatgcccatgaggcaatatgcagagaaagggaattcctaacttccgagggaacacctatcacacatcaggaagccattaggagattattactggcagtacagaaacctaaagaggtggaagtcttacactgctggggtcatcagaaaggaaagaaaagggaaatagaagggaactgccaagcagatattgaagcaaaaagagctgcaaggcaggaccctccattagaaatgcttatagaaggaaccctactatggggtaatgccctccgggaaacaaagccccagtactcagaagaagaaatagaatggggaacctcatgaggacacagtttcctcccctcaggatggctagccaccgaagaaggaaaaatacttttgcctgcagctaaccaatggaaaggtaaccaatggtgcactgtgaagtgtgccaaagaaataatcccctgcactgcaggctatacatttcaatccctgtatctttaacctccttgttaagcttgtctcttccagaatcgaagctgtaaaaccataaatagttcttcaaatggagcacctgatgcagtccatgactaagatctaccgcggacccctggaccggcctgctagcccatgctctgatgttaatgacatcgaaggcacccctcctgaggaaatctcaactgcacaaaccctactacaccccagttcagcaggaagcagttagagcggtcgtcggccaacctcctcaatggcacttgggttttcctgttgagaggggggactgagagacaggactagctggatttcctaggccgactaagaatccctaagcctagctgggaagctgaccacattcacttttaaacacagggcttgcaacttatctcacacccgacgaatcaggtagtaaagagggctcactaaaatgctaattaggcaaaaacaggaggtaaagaaatagccaataatttattgcctgagagtacagcgggaaggacaatgatcgggatataaactcatgcattcgagccaccaatggctaccctctttgggtcccctccctttgttatgggagctctattaaatcttgcaactgca

SEQ ID NO: 69 - DNA, 3471 bp, Homo sapiens
ttctcggcttagcagctgaagactgacactgctcgatcacctcggaagcctacgagaccatcacagatgctatgggtaactctcacagtggagggtaagtccttccccttcttagtcaatacagaggctacccactccacattaccttcttttcaagggcctgtttcccttgcctccataactgttgtaggtattgacagccaggcttctaaacctcttaaaactccccaactctagtgccaacttagacaatacttttttaagcactcctttttagttatccccacctgcccagttcccttatcaggctgagacactttaactaaattatctgcttccctgactattcctggactacagctgcatctcattgccgcccttctccccaacccaaagcctcctttgcatcttcttctcctatcccccaaccttaacccacaagtataggacatctctactccttccctggcaactgatcacatgcccattactatcccattaaaacctaatcaccctttccccgctcaacgccaatatcccatcccacagcacactttaaaaggattaatgcctgttatcactcgcctgctacagcatggccttttaaagcctataaactccccttgcaattcccccttttcactggtcctaaaaccagacaaggcttacacgttagttcaagatctgcaccttatcaaccaaattgttttgtctatccaccccatggtgccaaacctatatactctcctatcctcaatacctccctccacaatccattattctgttctagatctcaaacatgctttctttactattccttttcacccttcaacccagcctctcttcgctttcacttggactagaccctgacacccatcaggctcagcaaattacctgggctgtactgccacaaagcttcacagacagcccccattacttcagttaagcccaaatttcttccccatctgttacctatctcagcgtaattttcataaaaacacacgtgctctccccgcagatcatgtccagctgatctctcaaaccccaacaccttctacaaaacaacaactcctttccttcctaggcatggttagatactttcaactttagatacctggttttgccatcctaacaaaaccattatataaactcacaaaaagaaacctagctgaccccatagatcctaaatcctttccccactcctctttctgttccttgaagacagctttagagactgcccccaccctagctctccctgactcatcccaacccttttcattacacacagccaaattgcagggctgtgcagtcagaattcttacacaaggaccaggatcgtgtcctgtagcctttttgtccaaacaacttgaccttactgttttagactggccatcatgtctccgtgcagtggctgctgccaccctaaaacttttagaggccctcaaaatcacaaactatgctcaactcactctctacagctctcataatttccaaaatctattttcttcctcacacctgacgcatatactgtctgctccccggctccttcagctgtactcactctttgttgagtctcccacaattaccattgttcctggcccggacttcaatcctgcctctcacattattctggataccacacctgaccctcatgactgcatctctctgatccacctgacgttcaccccatttccccatatttccttctttcctgttcctcaccctgatcacacttagtttattgatggcagttccaccaggcctaatcgccacacaccagcaaaggcaggctatgctatagtacaagccactagcccgccccttaaaacctctcatttcctttccatcgtggaaatctatcctcaaggaaataacttctcagtgttccatctgctattctactacttctcaaggattattcaagccccctcccttccctacacatcaagctcgaggatttgcccccacccaggactggcaaattagctttactcaacatgccccaagtcagataactaaaatacctcttagtctaagtagacactttcactggataggtagaggcctttcctacaaggtctgagaacgccaccacagtcatttcttcccttctgtcagacataattcctcagtttagccttcccacctctatacagtctgataacagaccagcctttattagtcaaatcagccaagcagtttttcaggctcttagtattcagtgaaacctttatatcccttatggtcctcagtcttcaggaaaggtagaacctactaatggtcttttaaaacacacctcaccaagctcagccaccaactgaaaaaggactggacaacatgtttaccactttcccttctcagaattcaggcctgtccttggaatgctacagagtacagcccatttgagctcctgtatagacgctcctttttattaagccccagtctcattccagacaccagaccaacttggactgtgccccaaaaaacttgtcacccctattatcttctgtctagtcatactcctattctccgttctcaactactcatacaagccctgctcttgtttacactgccagtttacactgtttctccaagccgtcatagctgatatctcctggtgctatccctaaaatgccactcttaactcttgaagtaaataaataatctttgctggcaggactatgctgaatctcctttggcactctctaattagatgtcctaggtcctcccaattcttagacctttaatacctgtttttctccttctcttattccgtttagtttttcaattcatacaaaaccgtgtctaggccatcaccaataattctacatgacaaatgtatcttctaacaaccccacgatatcaccccttaccacaaagtcttccttcagcttaatctctcccactctaggttcccacgccacccctaatcccactcgaagcagccctgagaaacatcgcccattatttctccataccacccccgaaaatttttaccgtcccaacgctttaccactatttcattttatttttcttattaatataagaagacaggaacgtcaggcctctgagcccaagctaagccatcatatcccctgtgacctgcacgtacacatccagatggccggttcctgccttaactgatgacattccaccacaaaagaagtgaaaatggcctgttcctgccttgactgatgacattatcttgtgaaattccttctcctggctcatcctggctcaaaagctcccctactgagcaccttgtgacccccacacctgcccgccagagaacaacccccctttgactgtaattttcctttacctacccaaatcctataaaatagccccacccctacctcccttcactgactctctttttggactcaacccacctgcacccgggggaaataaacagccttgttgctcacacaaagcctgtttggtggtctcttcacttggacgtacatgaaa

SEQ ID NO: 70 - DNA, 812 bp, Homo sapiens
gtggggaaaagcaagagagatcagattgttactgtgtctgtgtagaaagaagtagacataggagactccattttgttatgtactaagaaaaattcttctgccttgagattctgttaatctataaccttacccccaaccccgtgctctctgaaacatgtgctgtgtcaactcagagttaaatggattaagggcggtgcaagatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtaaaagaggaaggaatgcctcttgcagttgagacaagaggaaggcatctgtctcctgcccgtccctgggcaatggaatgtctcggtataaaacccgactgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgactcatccccaccttaggagaaacacccacaggtgtgtaggggcaacccacccctaca

SEQ ID NO: 71 - DNA, 4071 bp, Homo sapiens
gtcaggcctctgagcccaagctaagccatcatatcccctgtgacctgcacgtatacatccagatggcctgaagcaacagaagatccacaaaataagtgaaaatagccttaactgatgacattccaccattgtgatttgttcccgccccaccctaactgatacgatatattctccccccgcccttaagaaggtactttgtaatattctcccccacccttgagaatgaactttatacgcctatcccaaacctataagaactattgataatcccaccaccctttgctgactcctttttcggactcagcccgcctgcacctaggtgaaataaacagcctgttgctcacacaaagcctgtttggtggtctcttcatacagacgcacgtgacatttggtgccgaagacctgggacaggaggactccttcgggagaccagttccctgtcctcgccctcactctgtgaggagatccacctaccaccttgggtcctcagaccaaccagcccaaggaacatctcaccaatttcaaaccgggtaagtggtcttttcactctcttctccagcctctctcgctacccttcaatctccctgtctttccaattccagttctttttcctctctagtagagacaaaggagacacattttatctgtggaaccaaaactctggcgccggtcacagactcgggaagacaggcttcccttggtgtttaatcactgcagggacacctgcctgattattcacccacatttcattggtgtctgatcaccacggggacgcctgccttggtcattcacccacattcccttggtggcaagtcaattatggggatgcctgctttggttgctcacccacattgcagcccagggctgttcaccacccccttctccgtgtctctacctttctctttaaacttgcctccctcactatgggcaaacttccgcccctccattcccccatcttctcccttagcctgtgttcttaaaaacctaaaatcccttcaactcacacctgacctaaaacctaaatgcctttttttcttcttcaataccgcttggccccagtacaaactcaacaatagctccaaatggcagagaacggcactctcgatttgtctatcccacaagacctagataatctttgtcgaaaaatgggcaaatggtctgaggtgccttacgtccaggcatttttcacacttcgttccccctctagtctctgttcccactgcgacttgtcccaaatcctcctcctttccctcccgcctgtcccttcagtcccaaccaaaagcgtcgctgagtcttttgaatcttccttttctactcacccatcggacctctcacctcctccccagactgctgctgctcagctcgctccccgccaggctaatcaggccccaactcttcttcagcctctgctcccccaccctataacccttctattacctccccttctcacacctggtctggtttacagttttgttctgtgaccagctctcccccacctgcccaacaatttcctcttagagaggtggctggagctgaaggcatagtcagggtacatgtgcctttttctctatcagacctttcccaaatcagccagtgtttaggctctttctcatcagaccccacgaaatatatacaggaattccgatatctaactctgtcctacaagttaacctggagagacttacatgtcatcctgacttccaccctctccccagatgaacgggaaagagttttctctctagcccagtctcacactgataaccaccagcttcatgagccaggcctccaggaaggcattagagcagttccccaagaggaccccctatggaactatcaggcagattccccaggtatagctaggccagattacatggtttcctgcctagttgaagggctcaaaaaggcagcatacaaagctgttaattatgacaagctaaaggaaactacccaaggtaaagatgaaaacccagcccagttcatggcctgcttagcagttagacactttaccgccctagacccagaggggccagaaggctgtcttattctcaatatgcattttattacccaatcccctcctgacattagaaaaagctccaaaaattagattccagccctcaaaccccacaacaggacttaattaacctcaccttcaaggtgtacaataatagagtagaggcaacgtatttctgagttgcaattacttgccactgtgagagaaacgccagccacatctccacacacgagaacttcaaaacgcctgaaccgcagcagctagttgttcctccaggaccgcctcccccaggatcttgcttcaagtgccggatatctagccactgggccaaggaacgcccactgcccgggattcctcctaagccatgtcccatctgtgctggaccccgttggaaattggactgtccagctcacccggcagccactcccagagcccctggaactctggcccaaggatctctgactgactccttcccagatcttctcagcttagtggctgaagactgacactgcctgatcaccttggaagcccacaggagcatcacagatgttttgggtaactcttacagtggagggtaagtccatccccttcttaatacggaggctacccgctccacattaccttcttttcaagggcctgtttcccatgcccccataactgttgtgggtattgatggccaggcttctaaacctcttaaaactccccaactctggtgccaacttggacaatattctcttatacactcctttttagttatccccacttgtccagttcccttattaggccgagacattttaaccagattatctgcttccttggttattcctggaaaacagccacatctcattgccacccttcttcccaacccaaagccttcttcacatcttcctcttgtatccccgcaccttaacccacaggtatgggacacctctactcccttcctggcaaccgatcacatgccccttaccatcccattaaaacctaatcacccttaccccgctcaacgccaatatcccatcccacagcatgatctaaaaggattaaagcctgttacagcatggccttttaaagcctataaactctccttacaattctcccattttacctgtccgaaaaccggacaagtcttacaagttagttcaggatctgcgctttatcaaccaaattgtcttgcctatcccaccccatggtgccaaacccatatactctcctgtcctcaatacctccctctacaacccattattctattctagataaacctagcagaccccgtaaatcctaaatcctttccccactcccctttccatttcttaaaaagcagccctaaaagctgctcccacactagcttcccctaactcaacccgacctttttcattacacatagccgaagtgcagggctgtgtgattggaattcttacacaagagctgggaccacaccctgtagcctttctgtccaaacaacttgaacttacttttagcctagccctcatgtctgcgagtggcagctgccgctgctttaatacttttagaggccctcaaaatcacaaactatgctcaattcactctctacagttctcataacttccaaaatatattttctttctcacacctgatgcatatacttcctgccctccggctccttcagctatactcactctttgttgagcctcctacaattaccattgtgcctggccccagacttcaatcaggccttccacattattcctgataccacacctgacctccatgactgtatctttctgatccaactgacattcactctgtttccccatatttccttctttcctgttccttaccctgatcacacttggcttattgatggcagttccaccaggcctaatcaccactcaccagcaaaggcaggctatgctatatagtatcttccacatctatcattgaggctaccgctctgtcccctccactacctctcagcaagctgaactcattggcttaactcgggccctcactcttgcaaagggactacatgtcaatatttatactgactctaaatatgccttccatatcctacaccaccatgc

SEQ ID NO: 72 - DNA, 5699 bp, Homo sapiens
gtcaggcctctgagcccaagctaagctatcatatcccctgtgacctacacatccaggtggcttgttcctgccttaactgatgacattccaccacaaaagaagtgaaaatggcctgttcctgccttaactgataacattgtcttatgaaattccttctcctggctcaccctggctcaaaagctcccctactgagcaccttgtgacccccattatgcccgccagagaacaactcccctttgacagtaattttcctttacctacccaaatcctataaaacggccccacccctatctcccttcactgactctcttttcggactcagcccacctgcacccaggtgattaaaagctttattgctcacacaaagcctgtttggtggtctcttcacatggacgtgcatgaaatttggtgccgtgactcagatccggggacttcccttgggagatcaatcccctgtcctcctgctctttgctctgtgaaaaagatccacctacgacctcaggtcctcagaccaagcagcccaaggaacatctcaccaattttaaatcgggtaagcggcctcttcttactctcttctccaacctctctcactgtccctcaaccactttctcctttccactcttcaatctctcccttctcttaatttcaattcctttcattttctggtaaagacaaaggagacacgttttatccatggacacaaaactccggcgccggtcacggactagggaaggcagccttcccttggtgtttagtcattgcagggacacctctctgattatttacacacgtttcagaggtgtcaatgcaggagggacgcctgcattggtccttcacccttagcggcaagtcccgcttttctggggaaggggcaagtaccccaaccatttctctccgtgtctctaccccttctccacctttctggggggcaagaaacccccaaccccttctccttcactcttagtggcaagtcccgcttttgtagaggaggggcaagtaccccaaccttgtatctctgcgccccaatcccttatttccgtggcccaacctcttatatctctgcgccccaatcccttatttccgtgccccgacctcttatctctgtgccccaaccccttatttccatgccccgacctcttatctctgtgccccaccccttatttccatgccccaacctcttatctctgtgccccaaccccttatatctgtgccccaacccctttcccacttttctggaaggtaagaacccccgaaccccttccctccatgtctctactctcccttttctctaggcttgcttccttcactatgggcaaccttccaccctcctttcctccttcttctgccttggcctgtgttctcaaagacttaaaacctcttcaactcacacctgacctaaaacctaaatgccttattttcttctgcaatgctgcttgaccccaatacaaactcaatagtagttccaaacagccggaaaacggcactttcaatttttccatcctgcaagatctaaataattcttgtcataaaatgggcaaacggtctgaggtgcctgacaaccaggcattgttttacacatcagtccctccctagtctctgtgcccagtgcaacttgtcccaaatcttccttctttccctcctgcctgtcccctcagtaccaatcccaagtgtcgctgagtctttctaatcttccttttctacagacccatctgacctctcccttcctccccaggctgctcctcgccaggccgagctaggtcccaattcttgctcagcctctgctcctccaccctataatccttttatcacctcccctcctcacacctggtccggcttacagtttcgttccatgactagccctcccccacctgcccagaaatttactcttaaaaaggtggctggagctaaaggcatatagtcaaggttaatgcgccattttctttatcccaaatcagatagtgtttaggctctttttcatcaaatataaaaactcagcccagttcatggctcgttcagcagcaaccctgagacgctttacagccctagaccctaaaaggtcaaaaggccgtcttattctcaatatacattttattacccaatctgctcccgacattaaataaaactccaaaaattaaattccagccctcaaaccccacaacaggatttaattaaccttgccttcaaggtgtacaataatagaaaaaagttgcaattctttgcctccactgtgagacaaaccccagccacatctccagcacacaagaacttccaaatgcctgaaccacagtgtccaggcattcctccagaacctcctccggcaggagcttgtacaagtgccagaaatctgaccaccaggccaaggaatgcctgcagcccaggattcctcctaagccgtgtcccatctgtgcaggaccccattggaaatcagactgttcaactcacctggcagccgctcccagagcccctggaactctggcccaaggctgtctgactgactccttctcggcttagcagctgaagactgacgctgcccgattgcctcggaagctccgtagaccatcacggatgccgagcttcgggtaactctcacagtggaagttaagtctgtccccttagtcaatacggaggctacccactccacattaccttcttttcaagggcctgtttcccttgcctccataactgttgtgggtattgacggccaggcttctaaacccctgaaaactcccccactctggtgccaactaggacaacactcttatgcactcttttttagttatccccacctgcccagttcccttattaggccaagatattttaaccaaattatctgcttccctgactattcctgggctacagccacatctcattgctgcccctctccccaacccaaagcctccttcgcgtcttcctctcatatccccccaccttaacccacaagtatgggacatctctacttccctggcaaccgatcacatggccgttaccatctcattaaaacctaatcacccttaccccgctcaacgccaatatcccatcccacagcacgctttaaaaggattaaagcctgttatcactcgcctgctacagcatgggcttctaaaacctataaactctccttacaattcccccattttacctgtccgaaaactggacaagtcttacagattagttcaggatctgcgccttatcagccaaattgttttgcctatccaccctgtgctgcccaacccgtacactcttttgtcctcaataccttcctccacaactcactgttccgtgcttgatcttaaagatgcttttttcactattcccctgcacctctcgtcccagcctctcttcgctttcacttagactgaccctgacacccattaggctcagcaaattacctaggctgtactgctgcaaggcttagtagacagcccccattacttcagtcaagcccaaatttcatcctcatctgttacctatctcggcataattctcataaaaacacacgtgctctccctgctgatcatgtccgattaatctcccaaacttcaatcccttacaaaacaacaactcctttccttcctaggcatggttagcgcagtcagaattcttacacaagagacaggaccacaccctgtagcctttctgtccaaacaacttgaccttactgttttagcctagccctcatgtctgcatgcagcggctgctgctgctttaatacttttagaggccctcaaaatcacaaactatgctcaactcactctctacagctctcataatttccaaaatctattttctgacccacacctgacgcatatactttctgctcccgggctccttcagctgtgcttactctttgttaagtcccacaattaccattgttcctggcccggacttcagtccggcctcccacattattcctgataccacacctgacccccatgactgcatctctctgatccacctgacgttcaccccatttccccacatttccttcttccctgtttctcaccctgatcacacttagtttattgatggcggttccaccaggcctaatcgccacacaccagcaaaggcaggctatgctatagtacaagccactagcccgcctcttagaacctctcatttcctttccattgtggaaatctatcctcaaagaaataacttctcagtgttccatctgctattctactactcctcagggattattcaggccccctcccttccctacacatcaagctcaaggatttgcccccacccaggactggcaaattagctttactcaacatgccccgagtaagataactaaaatgcctcttagtctaggtagacactttcactggataagcagagtcctttcctacagggtctgagaaggccaccacagtcatttcttcccttctgtcagacataattcttcagtttagccttcccacctcaatacagtctgataacagacgagcctttattagtcaaatcagccaagccttttttcaggctcttagtatccagtgacagactaatggtctattaaaaacacacctcacgaagctcagccaccaactcaaaaaggactggacaatacttttaccactttcgcttctcagaattcaggcctgtcctcagaatgctacaaggtacagcccatttaagctcctgtatagacgctcctttttattaggccccagtctccttccagacaccagaccaacttagactgtgcccccaaaaacctgtcatccctactatcttctgtctagtcatactcttattcagcgttctcaactactcatacatgccctgctcttgtttacactgccagtttacactgtttctccaagccatcacagctgatatctcctggtgctatccccaaaccgccactcttaactcttaaagtaaataaataatctttgctggcaaggctatgctgaaccttcttaggcactctctaatgagatgtcctaggtcctcccaattcttagtcctttaatacctgtttttctccttcttttattccatttagtttttcaattcatacaaaactgtatccaggccatcaccaataattctaaatgacaaatgtttcttctaacaatcccacaatatcaccccttaccacaaaatctcccttcagcttaatcgctcccactttaggttcccacgccgccccaatcccgcacgaagcagccctgagaaacatcgcccattatctctccataccctcatccaaaattttcatcatcccaacactttaccactatttcgttttatttttcttattaatataagacaggaatgtcaggcctctgagcccaagctaagccaccgtatcccctgtggcctgcacgtacacatccagatgacgggttcctgctttaactgatgacattccaccacaaaagaaatgaaaatggcctgttcctgccttaactgatgacattgtcttgtgaaattccttctcctggctcatcctggctcaaaggctcccctactgagcaccttgtgacccccactctgcccgccagagaacaactgccctttgactgtaattttcctttacctacccaaatcctataaaacggccccacccctatctccctttgctgactctcttcggactcagcccacctgcacccaggtgattaaaagctttattgctcacacaaagcctgtttggtggtctcttcacacggacgcgcatgaaa

SEQ ID NO: 73 - DNA, 4779 bp, Homo sapiens
aaaaatggcacttacaatgtttccatcctacaagatcaaaataattcttgtcgtaaaatgcgcaaacggtctgacgtgcctgacgtccaggcattcttttacacatcggtccctccctagtctctgtgcccaatgcaacttgtcccaaatcttccttctttccctcccgcctgtcccctcagtcccaaccccaagcgtcgctgagtctaatcttccttttctacagacccatctgacctctcccctcctccccaggctgctcctcgccaggccgagctaggtcccaattcttcctcagcctctgctcctccaccctataatctttttatcacctcccctcctcacacctggtcccgcttacagtttcgttccgtgaccagccctcccccacctgcccagcaatttcctcttaaaaaggtggctggagctaaaggcatagtcaaggttaatgctcctttttctttatctgacctctcccaaatcagttagcatttaggctctttttcatcaaatatgaaaaacccagcccagttcatggctcgtttggcagcaaccctgagatgctttacagccctagaccctaaaagatcaaaaggccgtcttattctcaatatacattttattacccaatctgcccccgacattaaataaaactccaaaaattaaattccggccctcaaaccccacaacaggacttaattaacctcgccttcaagatgtacaataatagagtagaggcagccaagtagcaacatatttctgagttgcaattccttgcctccactgtgagacaaaccccagccacatctccagcacacgaacttccaaacgcctaaaccgcagtggccaggcattcctccaggcctgccttccccagaagcttgctacaagtgccagaaatctggccaccaggccaaggaatgcccgcaacccaggattcctcccaagcctcgtcccatctgggcgggaccccactggaaatcagactgtccaactcacctggcagccactcccagagcccctggaactctggcccaaggctctctgactgactccttcccagatcttctcggcttagcggctgaagactgacactgcccaatcgcctcagaagcccctagaccatcacggacgccgagctttaggtaactctcacagtggagggcaagtccatccccttcttaatcaatacggaggctacccactccacattaccttcttttcaagggcctgtttcccttgcctccgtaactgttgtgggtattgacagccaggcttctaaacctcttaaaactctccaactctggtgccaacttagacaatactcttttaagcactcctttttagttatccccacctgcccagttcccttattaggctgagacactttaactaaattatctgcttccctgactattcctggactacagccacatctcattgccacccttcttcccaatccaaagcctcctttatgtcctcctcttgcatccccccaccttaacccacaagtataggatacctctactccctccttggtgaccgatcatgcaccccttaccatctcattaaaacctaatcacccttaccccactcaatgccaatatcccatcccacagcacgctttaaaaggattaaagcctgttatcactcgcctgctacagcatggccttttaaagcctataaactctccttacaattcccccattttacctgtcctagaaccaaacaagccttacaggttagttcaggatctgtgccttatcaaccaaactgttttgcctatgcaccccgtggtgccaaacccatatactctcatatcctcaatacctccctccacaatccattattctgttctagaactcaaacatgctttctttactattcctttgcacccttcatcccagcctctctttgctttcacttggactgaccctgacacccatcaggctcagcaaattacctaggctgtactgctgcaaagcttcacagacagcccccattacttcagtcaagcccaaatttcttcctcatctgttacctatctcagcataattctcgtaaaaacacatgtgctctccctgctgattgtgtccgaataatctcccaaacctcaatcccttccacaaaacaacaacttctttccttcctaggcatggttactgcggtcagaattcttacacaagagccaggaccgcaccctgcagcgtttctgtccaaacaacttgaccttactgttttagcctagccctcatgtctgcatgcagtggctgccactgctttaatacttttagaggccctaaaaatcacaaactatgctcaactcactctctacagttcttataacttccaatatctattttcttcctcatacctgacgcatatactttctgcttcccggctccttcagctatattcactcttcgttgagtcttccacaattaccattgttcctggcatggacttcaatctggcctcccacattattctggataccacacctgaccctcatgactgtatctctctgatccacctgacattcaccccatttccccatatttccttatttcctgttcctcaccctgaacacatttagtttattgatggcagttccaccaggcctaatcaccactcaccagcaaaggcaggctatgctatattatcttccacatctatcattgaggccactgctctgcccacctccactacctctcagcaagccgaactagttgccttaactgaagccctcactcttgcaaaaacactacgtgtcaatatttatactgactgtaaatatgtctttcatattttgcaccaacatgctgttacataggctgaaagaggtttcctcactatgcaaaggtcctccattattaatgcctctttaataaaaactctgctcaaggccactttacttccaaaggaagctggagtcattcactacaaaggccatcaaaaggcgtcagatcccattgctctaagcaacgcttatgctgataaggtggctagacaagcagctagctttccaaattctgtccctcacagccagtttttctccttcacatcggtcactctcacctactcccccgctgaaactgccacctatcaatctcttcccatacaagtgaaatagttcttagaccaaggaaaatatctccttccagcctcacaggcccattctattctgtcgtcatttcataacctcttccatgtaggttacaagccactagcccgtctcgtagaaccgctcatttcctttccatcctagaaatatatcctcaaagaaatcacttatcagtgttccatgtgctattctactacccctccctttcctgcacatcaggctcagggatttgcccctgccccggactggcaaattgactttactcacatgccccaagtcagaaaactaatacctcttggtctgggtaaacactttcactggataggtagaggcctttcctacagggtctgagaaggccaccacggtcatttcttcccttctgtcagacataattcctcagtttggccttcccacctctatacagtctgatagtagactggcctttattagtcaaatcagccaagcattttttcaggctcttggtattcagtgaaacctttatatcccttaaagtcctcagtcttcaggaaaggtagaacagacaaatggtcttttaaaaacacacctcaccaagctcagccaccaacttaaaaaggactggacaatacttttaccacttccccttcccagaagtcagacctgttctcggaatactacagggtacagcctatttgagctcctgtatggacgctcctttttattaggccccagtttcattccagacaccagaccaaattggaccgtgccccaaaaaacttgtcatccctactatcttgtctagtcatactcctattcactgttctcaactactcatacttgccctgctcttgtttacactgccagtttacactgtttctccaagccatcacagctgatatctcctggtgctatccccaaactgccactcttaactcttaaagtaaataaataatctttgctggcaggactatgctgaatctccttaggcactctctaattaaatgtcctaggtcctccccaattcttagacctttaatacctgttattctccttctcttattccgtttttcaattcatacaaaaccgtatccaggccatcaccaataattctaaatgacaaatgtttaccacaaaatcttccttcagcttattctctcccactctaggttcccatgccacccctatcccgctcgaagcagccctgagaaacatcgcccattatctctccatatcacccccaaaaatttttgccgtcccaacaccttaccactatttcattttatttttcttattaacataagaagacaggaatgtcaggcctctgagcccaagctaagtcatcatatcccctgtgacctgcatgtacacatccagatggccagttcttgccttagctgatgacattccaccacaaaagaagtgaaaatggcctgttcctgccttaactgatgacattatcttgtgaaattccttctcctggctcatcctggctcaaaagctcccctgctgagcaccttgtgacccccattcctgccccccatagaacaacccccctttttcctttacctacccaaatcctataaaacagctgcaccccatctccctttgctgactctcttttcggacttagcccacctgtacccaggtgattaaaaagctttattgttcacacacac

SEQ ID NO: 74 - DNA, 179 bp, Homo sapiens
cccagagatttctttgtttgggaaaataagaccaagggagctaatcaaagccaagccccatgaatacaaaccttagcaggcataactatagccacgagttatctggctgtattggcagccttgagattttgttttgttttgttttgttttgagctgtccttatccctttgtttcatttt

SEQ ID NO: 75 - DNA, 6487 bp, Homo sapiens
gtggggaaaagcaagagagatcagattgttactgtgtctgtatagaaagaagtagacataggagactccattttgttctgtactaagaaaaattcttctgccttgagatgctgttaatctatgaccttacccccaaccccatgctctctgaaacatgtgctgtgtcaaactcagggttaaatggattaagggttgtgcaagatgtgctttgttaaacaaatgcttgaaggcagcatgctccttaagagtcatcaccactccctaatctcaagtacccagggacacaaacactgcggaaggccgcagggacctctgcctaggaaagccaggtattgtccaaggtttctccccatgtgatagtctgaaatatggcctcgtgggaagggaaagacctgaccgtccccctgcccgacacccgtaaagggtctgtgctgaggaggattagtataagaggaaggcatgcctcttgcagttgagacaagaggaaggcgtctgtctcctgcccgtccctggacaatggaatgtctcggtataaaacccgattgtacgttccatctactgagatagggaaaaacgccttagggctggaggtgggacatgcgggcagcaatactgctttgtaaagcattgagatgtttatgtgtatgcatatctaagagcacagcacttaatcctttacctcgtctatgatgcaaagacctttgttcacgtgtttgtctgctgaccctctccccactattgtcttgtgaccctgacacatccccctctcggagaaacacccacgaatgatcaataaatactaagggaactcagaggctggcgggatcctccatatgctgaacgctggttccccgggtccccttatttctttctctatactttgtctctgtgtctttttcttttccaagtctctcgttccaccttacgagaaacacccacaggtgtggaggggcaacccaccccttcatctggtgcccaacgtggaggcttttctctagggtgaaggtactctcaagcgtggtcattgaggacaagtcgacgagagatcccgagtacgtctacagtcagccttacggtaagcttgtgggctcagaagaagctagggtgataatggggcaaactaaagtaaaactaaaagtaaatatgcctcttttctcagctttattaaaattcttttaaaaagagggggagttaaagtatctacaaaaaatctaatcaagctatttcaaacaatagaacaattttgcccatggtttccagaacaaggaactttagatctaaaagattggaaaagaattgttaaggaactaaaacaagcaagtaggaagggtaatatcattccacttacagtatggaatgattgggccattattaaagcagctttagaaccatttcaaacagaagaagatagcgtttcagtttctgatgcccctggaagctgtttaatagattgtaatgaaaagacaaggaaaaaaatcccagaaagaaacggaaggtttacattgcgaatatgtagcagagccggtaatggctcagtcaatgcaaaatgttgactataatcaattacaggaggtgatatatcctgaaacgttaaaattagaaggaaaaggtcccgaattagtggggccatcagagtctaaaccacgagggccaagtcctcttccagcaggtcaggtgcccgtaacattacaacctcaaacgcaggttagagaaaataagagccaaccaccagtagcttatcaatactggccgctggctgaacttcagtatcagccacccccagaaagtcagtatggatatccaggaatgcccccagcaccacagggcagggcgccataccctcagccgcccactaggagacttaatcctacggcaccgcctagtagacagggtagtgaattacatgaaattattgagaagaaaggaaggagatactgaggcgtggcaattcccagtaacgttagaaccgatgccacctggagaagaagcccaagagggagagcctctcacagttgaggccagatacaagtcttttttgataaaaatgctaaaagatatgaaagagggagtaaaacagtatggacccaactccccttatatgagtacattattagattccattgctcatggacatagactcattccttatgattgggagattctggcaagatcatctctctcaccctctcaatttttacaatttaagacttggtggattgatggggtacaagaacaggtccgaagaaatagggctgccaatcctccagttaacatagatgcagatcaactattaggaagaggtcaaaattggagtactattagtcaacaagcattcatgcaaaatgaggccattgagcaagttagagctatctgccttagagcctgggaaaaaatccaagacccaggaagcgcctgcccctcatttaatacagtaagacaaggttcaaaagagccctaccctgattttgtggcaaggctccaagatgttgctcaaaagtcaattgccgacgaaaaagcccataaggtcatagtggagttgatggcatatgaaaacgccaatcctgagtgtcaatcagccattaagccattaaaaggaaaggttcccacagggtcagatgtaatctcagagtatgtaaaagcctgtgatggaatcggaggagatatgcataaagctatgcttatggctcaagcaataacaggagttgttttaggaggacaagttaaaacatttggaggaaaatgttataattgtggtcaaattggtcatttaaaaaagaattggccagtcttaaataaacagaatataactattcaagcaactacaacaggtagagagccacctgacttatgtccaaaatgtaaaaaaggaaaacatggggctagtcagtgtcattctaaatttgataaaaacaggcaaccattgtcgggaaatgaacaaacgggccagcctcaggccccacaacaaactggggcattcccaattcagccatttgttcctcagggttttcagggacaaaaacccccactgtcccaagtgtttcagggaataagccagttaccacaatacaacaattgtcccccgccacaagcggcagtgcagcagtagatttatgtactatacaagcagtctctctgcttccagggaagcccccacaaaaaatccccacaggggtatatggcccactgcctgaggggactgtaggactaatcttgggaagatcaagtctaaatctaaaaggagttcaaattcatactggtgtggttgattcagactataaaggcgaaattcaattggttattagctcttcaattccttggagtgccagtccaggagacaggattgctcgattattactcctgccatatattaaggttggaaatagtgaaataaaaagaacaggagggtttggaagcactgatctgacaggaaaggctgcatattgggcaagtcaggtctcaaagaacagacctgtgtgtaaggccattattcaaggaaaacagtttgaagggttggtagacactggagcagatgtctctatcattgctttaaatcagtggccaaaaaattggcctaaacaaaaggctgttacaggatttgtcggcataggcacagcctcagaagtgtatcaaagtactgagattttacattgcttagggccagataatcaagaaagtactgttcagcccatgattacttcaattcctcttaatctgtggggtcgagatttattacaacaatggggtgtggaaatcaccatgccctctccattatatagccccaggagtcaaaaaatcatgaccaagatgggatatataccaggaaagggactagggaaaaatgaagatggcattaaagttccagttgaggctaaaataaatcaagaaagagaaggaatagggtatccttgttaggggcggccactgtagagcctcctaaacacataccattaacttggaaaacagaaaaaccggtgtgggtaaatcagtggccgctaccaaaacaaaaactggaggctttacatttattagcaaatgaacagttagaaaagggacatattgagccttcattctcgtcttggaattctcctgtgtttgtaattcagaagaaatccggcaaatggcatatgttaactgacttgagggccgtaaacgctgtaattcaacccatggggcctctccaacctgggtcaccctctctggccatgatcccaaaagattggcctttaattataattgatcaaaaggattgcttttttaccatccctctggtggagcaggattgcgaaaaatttgcctttactataccagccataaataataaagaaccagccaccaggtttcagtggaaagtgttacttcagggaatgcttaatagtccaactatttgtcagacttttgtaggtcaagctcttcaaccagttagagacaagttttcagacggctatattattcattattttgatgatattttatgtgctgcagaaacgagagataaattaattgactgttatacatttctgcaagccgaggttgccaatgcaggactggcaatagcatctgataagatccaaacctctactccttttcattatttagggatgcagatagaaaaattaagccacaaaaaatagaaataagaaagacacattaaaaacactaaatgattttcaaaaattgctgggagatattaattggattcggccaactctaggcattcctacttatgccatgtcaaatttgttctctatcttaagaggagactcagacttaaatagtaaaagaatgttaaccccagaggcaacaaaagaaattaaattagtggaagaaaaaattcagtcagcgcaaataaatagaatagatcccttagccccattccaacttttgatttttgccactgcacattctccaacaggcatcattgttcaaaatactgatcttgtggagtggtcattccttcctcacggtacagttaagacttttacattgtacttggatcaaatagctacattaattggtcagacaagattatgaataataaaattatgtggaaatgacccagacaaaatagttgtccctttaacaaaggaacaagttagacaagcctttatcaattctggtgcatggcagattggtcttgctaattttgtgggaattattgacaatcgttacccaaaaacaaaaatcttccagttcttaaaattgactacttggattctacctaaaattagcagacgtgaacctttagaaaatgctctaacagtatttactgatggttccagcaatggaaaagtggcttacacagggccgaaagaacgagtaatcaaaactccatatcaatcggctcaaagagcagagttggttgcagtcattacagtgttacaagattttgaccaacctatctatattatatcagattctgcatatgtagtacaggctacaagggatgttgagacagctctaattaaatatagcatggatgatcagttaaaccagctattcaatttattacaacaaactgtaagaaaaagaaatttcccattttatattactcatattcaagcacacactaatttaccagggcctttgactaaagcaaatgaacaagctgacttactggtatcatctgcattcataaaagcacaagaacttcatgctttgactcatgcaaatgcagcaggattaaaaaacaaatttgatgtcacatggaaacaggcaaaagatattgtacaacattgcacccagtgtcaggtcttacacctgcccactcaagaggcaggagttaatcccagaggtctgtgtcctaatgcgttatggcaaatggatgtcacgcatgttccttcatttggaagattatcatatgttcatgtaacagttgatacttttcacatttcatatgggcagcttgccaaacaggagaaagtacttcccatgttaaaaaacatttattgtcttgttttgctgtcatgggagttccagaaaaaatcaaaactgacaatggaccaggatattgtagtaaagctttccaaaaattcttaagtcagtggaaaatttcacatacaacaggaattccttataattcccaaggacaggccatagttgaaagaactaatagaacactcaaaactcaattagttaaacaaaaagaagggggagacagtaaggagtgtaccactcctcagatgcaacttaatctagcactctatactttaaatttttttaaacatttatagaaatcagactactacttctgcagaacaacatcttactggtaaaaagaacagcccacatgaaggaaaactaatttggtggaaagataataaaaataagacatgggaaatagggaaggtgataacgtgggggagaggtttgcttgtgtttcaccaggagaaaatcagcttcctgtttggatacccactagacatttgaagttctacaatgaacccatcggagatgcaaagaaaagggcctccacagagatggtaacacc

SEQ ID NO: 76 - DNA, 6025 bp, Homo sapiens
gtcaggcctctgagcccaagctaaaccatcatatcccctgtgacctgcacgtatatatccagatggcctgaagtaattgaagaatcacaaaagaagtgaaaatggcctgttcctgccttaactgatgacattaccttgtgaaattccttctcctggctcatcctggctcaaaagctcccccactgagcaccttgtgtcccccgcccctgcccaccaaggaacacccccctttgactgtaattgtccactacctacccaaatcctataaaatggccccacccctatctcctttcgttgactcttttttcagactcagccggcctgcaaccaggtgattaaaaagctttattgctcacacaaagcctgttgggtggtctcttcacatggacgtgcgtgaaatttggtgccatgactcggatcgggggaccacccttggaagatcaatcccctgtcctcctgctctttgcttcatgataaagatccacctaatgacctcgggtcctcagaccaaccagcctgaggaacatctcaccaattttaaatcaggtaagcggcctctttttactctcttctccaacctctctcactatccctcaacctctttctcctttcaatcttggtgccatctttcaatctctcccttctcttaatttcggttcctttccttttctggtagagacaggaaatgcattttatctgtgaacccaaaactccggcgccgatcacggactcaggaagacagtcttcccttggtgtttaatcactgcggggacgcctgcttgattattcacccacgtttcagagttgtctgatcaccgcgaggatgcctgccttgatctttcacccttagtggcaaacaccactttttggggggcaagtaccccccaccccttctctccatgtttctaccctctcttttctctccacgttcctgggggacaagcacccccgactccttctctctgtgtctctaccctctcttttctctccactttcctggggggcaaagcaccccccaccccttctctccgtgtctctaccctctcttttctctgggcttgcctccttcactgtgggcaacattccaccctccattcctccttcttctctcttagcctgtgttctcaagaacttaaaacctcttcaactcacacctgacctaaaacctaaatgccttattttctttgcaatgccgcttaaccccaatacaaactcaacaatggttccaaatagccagaaaacggcactttcgatttttccatcctacaagatctagataattcttgttgtaaaatgggcaaacagtctgaggtgcctgatgtccaggcattcttttacacatcggtccctccctagtctctgttcccaatgcgactcatcccaaatcctccttctttccctcccgcctgtcccctcagtcccaaccccaagcgtcgctgcgtcttttcaatcttccaatcttccttttctaccgacccatctgacctctcacctaatccccagaatgctcctcaggtcactccccaccaggctgaatcagactccaattctttctcagcttctgctcctccaccctataatccttctatcacctcctctccccacacccagtccggcttacagttttgttctgcgactagccctccccaacctgcccaacaatttcctcttaaagaggtggctggagctaaaggcatagtcaaggttaacgctccttttcctttatccgacctctgccaaatcagttagtatttaggctctttttcatcaaatataaaaacccagcccagttcatggctcgttgggcagcaaccctgagacgctttacagccctagaccctaaaaggtcaaaaggcagtcttattctcaatatacattttattacccaatccactcccaacattaaataaaactccaaaaattaaattccggccctcaaaccccataacaggacttaattaacctcgccttcaaggtgtacaataatagagtaaaggcagccaagtagcaatgtatttctgagttgtagttccttgcctccactgtgagagaaaccccagccacatctccagtacacaagaacttcaaaatgcctaagctgcagcagtcaagcattcctacaggaccttctccatcaggatcttgcttcaagtgccagaaatctggccactgggccaaggaatgcccacagcccaggattcttcctaagccttgtcccatctgtgtggaaccccactggaaatcggactgtccaactcacctggcagccactcccagagcccctggaactctggcccaaggctgcctgactgactccttcccaaatcttctcggcttagcagctgaagactgacactgcccaatcgccttggaagcttcctggaccatcacagatgctttgggtaactcttacagtggagggtaagtccgtccccttcttaatcaatacggaggctaccaactccacattaccttcttttcaaaggcctgtttcctttgcctccataactgttgtgggtattgatggccaggcttctaaacctctcaaaactccccaactctgaggccaacttggacaatactcttttatgcactccttttcagttatccccacctgcgcagttcccttattaggccgagacactttaaattatctgcttccctgactattcctaggctacagccacacctcattgccaccttttcccccagttcaaagcctccttcacatcctccccttgtatctccccaccttaatcctcaagtataggacacctctattccctccttggcgactgatcatgcaccccttaccatcccattaaaacctaatcacccttaccgtgctcaatgtcaatatcccatcccccagcaggctttaaaaggattaaagcctgttatcactcgcctgttacagcatggccttttaaagcctataaactctccttacaattcccccattttacctgttcaaaaaccagacaagtcttacaattagttcaggatctgtgccttgtcagccaaattgttttgcctatccaccccgtggtgccaaactcatatactctcctcctcaatacctccctccacaacccctccacaacccatcattctcttctggatttcaaacatgctttctttactattcatttgcacccttcatctcagcctctcttcgctttcacttggactgtccctgacacccatcaggctcagcaaactacctaggctgtactgccgcaaggcttcacggacagcccccattacttcagtcaagcccaaatttcttcctcatccattacctatcttggcatagttctcatgaaaacacacgtgctctccctgctgatcatgtccggctaatctcccgaaccccaatcccttctacaaagcaacaactcctttcctttcaagggatggttaggtacttccacctttggatacctagttttaccatcctgactaaaccattatataaactcacaaaagcaaacctagctgaccccacagatcctaaatccttttgccactcctttccattccttaaaaacagccgtagaagctgctctcacactaggtctccctaattcatcccaaccctttttcatcacacacagccaaagtgcagggctgtgcggttggaattcttacacaagagctgggaccacgccctgtagcctttctgtccgaacaacttgaccttactgttttggcctagccctcatgtctgcgtgcagcggctgccgctgctttaatactttcagaggccctcaaaatcacaaactatgctcaactcactctctacagttctcataacttccaaaatctattttcttcctcacacctgacgcatatactttctgcccccctccactacctctcagaaagcttaactcattgccttaactcgagccctcagtcttgcaaaaggactatgtgtcaatatttatactgactctaaatatgccttccatatcctgtacctccatgctgttatatgggcaaaaagctttcctcattacacaagggtcctccatcattaattcctctttaataaaaactcttctcaaggccgctttacttccaaaggaagctggagtcattcactgcaagggccatcaaaaggcatcagatcccatcgctcagggcaacacttatgctgataaggtagctaaaaaagcagctagcattccaacttctgtccctcatggccagtttttctccttctcatcagtcactcctacctactcccccaatgaaacttacacctatgaatctcttcccacacaaggcaaatggttctcagaccaaggaaaatatctccttctagcctcacaggcccattctattctttcgtcatttcataacctcttccatgtaggttacaagccgctagcctgcctcttagaacctctcatttcctttccattgtggaaatctatcctcaaggaaatcacttctcagtgttccatctgctattctactactcctcagggattgttcaggccccctcccttccctacacatcaagcctggggatttgcctctgcccaggactggcaaattgactttactcacatgccccgagtcaggaaactaaaatacgtcttggtctgggtagatactttcactggatgggtagaggcctttcccacagggtctgagaaggccactgcggtcatttcttcccttctgtcagacataattcctcagtttggccttcccgcctctatatagtccaataacagaccagcctttactggtcaaatcacccaagcagtttctcaggctcctggtattcagtgaaaccttcataccccttaccatcctcaatcttcagaaaaggtagaacggactaatggtcttttaaaaacacacctcaccaagctcagccaccaacttaaaaaggactgacaatacttttaccacttgcccttctcagaatttgggcctgtcctcggaatgctgcagggtacagcccattcaagctcctgtatagatgctcctttttattaggccccagtctcattccagacaccagaccaacttggactgtgccccagaaaacttgtcatccctactatcttctgactagtcatactcctattcaccatactcaactactcatacatgccctgctcttgtttacactgccggtttacactgtttctccaaaccattacagctgatatctcctggtgctatccccaaactgccagtcttaactccctcttaaagtaaataaataatctttgctggcagggctatgctgaacctccttgggcactctctaattggatgtcctgggtcctcccaattcttagtcctttaatacctgtttttctccttctcttattccatttagtttttcaattcatacaaaaccgtatccaggccatcaccaataatcctatacaacaaatgtttcttctaacaaccccacaatatcatcccttaccacagaatctgccttcagcttaatctctcccactctaggttcccacgccaccccaatcccgctcgaagcagcccttcaaggctatggagaagcagtatctctccataccaccccccgccaaaatgtttgctgccccaacacttcaacactattttatgttatttttcttattaataaaagaagacaggaatgtcaggcctctgagcccaagctaagccatgatatcccctgtgacctgcacgtatacatccagatggcctgaagtaactgaagagtgaaaatggcctgtgcctgccttaactgatgacattatcttgtgaaattccttctcctggctcatcctggctcaaaagctcccccactgagcaccttgtgtccccccaccgccagagaacaaccccctttgactgtaattttccactacctacccaaatcctgtaaaacggtcccaccccatttcccttcgctgactcttttttcggactcagctggcctgcacccaagtgattaaaaagctttattgttcaaagcctgtttggtggtctcttcacatggacgtgcgtgaaa

SEQ ID NO: 77 - DNA, 696 bp, Homo sapiens
ttacagtaggtagtcgggcaggcatgagcagggcaggagagtccccaacccaggaatgtcaggtgaccatcagatggtcaggtggttgttacagtgtgtcgctgaaataataattggtcacagctggtgccagggacaggcagtctcccagtagatagaaacacctgaagctggtgatcagcagcttcctgataagatctcagcagttgggtgtgtgggttcaagcatgcgcactaagaggcaaaatggtataactggtatattaccttcctctaggaacgagacaggtaagtggagaattcctcaaatgagcatgcacacaacttcagtaaacccacggtgcaggtacagcatttgcccttcccaagtgctggcaggccactgtgcatgtggacagcccacccaaagggaagaatcaggaggaaataacgcaacaggaagatgccaacataagaccccaggtcaaaggtcaaaccgtacacttgactctctcacaggcctcccaccgggctctcttacaagcgtgcttcactccatttcattcctgccctgatagttgttaatacactttcactcctgctctaaaacttgcctcagtttctcactctgccttatacctcctctgtctaattctttctctgaggaggcaagaactggggttgctgcaggcctgtatggatttgctgctgctaatat

SEQ ID NO: 78 - DNA, 327 bp, Homo sapiens
tgggtcaggcacaaagtaagcccaccccactaggaactatgttgaaaaatttcaagaaaggatttaaaggagattatggtgttactatgacaccaggaaaacttagaactttgtgtaaatagactggccagcattagaggtaggttggccatcagaaggaagcctggacaggtcctttgtttcaaaggtatggcacaaggtaacctgtaagccaggtcacccagaccagttcctgtatatagacacttggttacactgattttaaacacccccccaacagtggttgagagaacagcagcataagcagctggcagaggcaaggaaaga

SEQ ID NO: 79 - DNA, 5603 bp, Homo sapiens
aacattctaccacaaaagaagtgaaaatggcctgttcctgccttaactgatgacattgtcttgtgaaattccttctcctggctcatcctggctcaaaagctcccccactgagtaccttgtgacccccactcctgcccgccagagaacccccctttttcctttacctacccaaatcctataaaacagccccaccccatctcccttcactgactctcttttcggactcagcccgcctgcacccaggtgaaataaacagccatgttgctcacacaaagcctgtttggtggtctcttcacaccgacgcgcatgaaatttggtgccatgactcagatgggggacctcccttgggagatcaatcccctgtcctcccactctttgctccgtgagaaagatccacctatgacctcaggttctcagaccaagcagcccaagaaacatctcaccaatttcaaatccagtaagcggcctctttttactctcttctccaacctccctaaccctcagcctctttctcctttcaatcttggcgccacacttcaatctctcccttcttttaatttcagttcctttcattttctggtagagacaaaggagacacgttttatccgtagacccaaaactccggtgccggtcacggactgggaatgcagccttcccttagtgtttaatcattgcaaggacacctctctgattattcccccacgtttcagaggtgtcagaccacacagggacgcctgccttggtccttcacccttagcggcaagtcccgcttttctgggggaggggcaagtaccccaaccccttctctccgtgtctctaccccttctccacctttctggggtgcaagaaacccccaaccccttatccttcacccttagcggcaagtccggcttttctggaggagaggcaagtaccccaacctcatatctctgcaccccaatcccttatttctgcaccctgacctcatatctctgtgccccaatcccttatttctgcaccccaacctcatatctctgctccccgatcccttatttccatgccccaacctcttatatctctgcaccccatcccttatttccatgccccaacctcctatctctgtgcctgaccccttctctgcttttctggagggcaagaaccccctaccccttctccgtgtctctactcttttctctgggcttgcctccttcactataggcaagcttccaccttccattcctccttcttcttccttagcctgtgttcttaagaacttaaaacctcttcaactctcacctgacctaaaatctaagtgtcttattttcttctgcaatgccgcttgaccccaatacaaactccacagtagttccaaatagccagaaaacagcactttcaatttttccatcctacaagatctaaataatgcttgtcgtaaaataggcaaatggtctgagatgcctgatgtccaggcattcttttacacatccgtccctctctagtctctgttcccaatgcaactcatcacaaatcttccttctttccctcccacctgtcccctcagtcccaaccccaagcgtcgccgagtctttctaatcttccttttctacagacccatctgacctctctcctcctcgccaggccgagctaggtcgcaattcttcctcagcctctgctcctccaccctataatccttttatcacctcccctcctcacacccggtccggcttacagtttcgttccatgactagccctccccctcctgcccagcaatttactcttgaaaaggtggctggagctaaattaaagttaatgctcctttttctttatcccaaatcagatagcgtttaggctctttttcatcaaatataaaaaacccagcccagttcatggctcgttcggcagcaaccctgagacactttacagccctagaccctaaaaggtcaaaaggccgtcttattctcaaaatacattttattacccaatctgctcccgacattaaataaaactccaaaaattaaattccggccctcaaaccccacaacaggatttaattaacctcgccttcaaggtgtacaataatagaaaaaagttgcaattccttgccttcactgtgagacaaaccccagccacatctccagcacacaagaacttccaaaggcctaaacctcagcgtccaggcgttcctccagaacctcctccccgaggagcttgctacaagtgccagaaatctgaccaccaggccaaggaatgcctgcagcccaggattcctcctaagccgtgtcccatctgtgcgggaccccactggaaatcagactgttcaactcacctggcagccactcccagagcccctggaactctggccgaaggctctctgactgactccttctcagcttagcggctgaagactgacgctgcccgatagcttcggaagtcccgtagaccatcacagatgccgagctttaggtaactctcacagtggagggtaagcccgtccccttcttaatcaatacggaggctacccactccacattaccttcttttcaagggcctgtttcccttgcctccataactgttgtgggtattgatggccaggcttctaaacctcttaaaactccccaactctagtgccaacttagacaatactcttttaagcactcctttttagttatccccacctgcccagttcccttattagactgagacactttaactaaattatctgcttccctgactattcctgggctacagccacacctaattaccaccttttccctcagttcaaagcctccttcacatcctccccttgtatctccccaccttaacccacaagtataagatacctctactccctccttggcgaccaatcacacaccccttaccatctcattaaaacctaatcacccttactccgctcaatgccaagatcccatcccacagcacgctttaaaaggattaaagcctgttgtcactcgcctgctacagcatggccttttaaagcctataaactctccttacaattcccccatcttacctgtcctagaacaagacaagccttacaagttagttcaggatctatgccttatcaaccaaattgttttgcctatccaccccgtggtgccaaacccatatactctcctatcctcaatacgtccctccacaacccattattctgttctggatctcaaacatgctttctttactattcctttgcacccttcatcctagcctctcttcgctgtcacctggactgaccctgacacccatcaggctcagcaaattacctgggctgtactgccggaaggcttcacagacagcccccattacttcagtcaagcccaaatttcttcctcatctgttacctatctcagcataattctcataaaaacacacgtgctctccctgctgatcgtgtccgattaatctcccaaacctcaatcccttataaaacaacaactcctttccttcctaggcatggttagtgcagtccgaattcttacacaagagccaggaccgcaccctgtaacctttctatgcaaacaacttgaccttactgttttagcctagccctcatgtctccgtgcagtggctgctgccgccctaatacttttagaggccctcaaaatcacaaactatgctcaacttactctctacatttctcataacttccaaaatctattttcttcctcatacctgatgcatatactttctgctccccggctccttcagctgtactcactctttgttaagtcccacaattaccattgttcctggcccggacttcaatctggcctcccacattattcctgataccacacctgacccccatgactgtatctctctgatccacctgacactcaccccatttccccatatttccttctttcctgttcctcaccctgatcacgcttgatttattgatggcggttccaccaggcctaattgccacacaccagcaaaggcaggctatactatagtacaagccactagcccgcctcttagaacctctcatttcctttccatcgtggaaatctatcctcaaggaaataacttctcagtgttccatctgctattctactactcctcagggattattcaggtcccctcccttccctacacatcaagcttgaggatttacccccacccaggactggcaaattaactttactcaacatgccctgagtcagataactaaaatacctcttagtctaggtagacactttcactagataggaagaggcctttcctacagggtctgagaaggccaccgcagtcatttcttcccttcagtcagacataattcctcagtttagccttcccacctctatacagtctgataacagacgagcctttattagtcaaatcagccaagcagtttttcaggctcttagtattcagtgaaacctttatatccattacagtcctcagtcttcaggaaaagtagaacagactaaaggtcttttaaaaacacacctcaccaagctcagccaccaacttaaaaaggactgaacaatacttttaccactttcgcttctcagaattcaggcctgtcctcagaatgctacaaggtacagcccatttgagctcccatatagatgctcctttttattaggccccagtctcattccagacagcagaccaacttagactgtgccccaaaaaacttgtcatccctactatcttctgtctagtcatactcctattcaccattctcaactaatcatacatgccctgctcttgtttacactgccagtttacactgtttctccaagccatcacagctgatatctcctggtgctatccccaaactgccactcttaactcttgaagtaaataaataatctttgctggcaggactatgctgaatctccttaggcactctttaatcagatgtcctaggtcctcccaattcttagaccttttatacctgtttttctccttttcttattccgtttagtttttcaattcatacaaaactatatccaggccatcaccaataattctaaatgacaaatgtttcttctaacagccccacaatatcaccccttaccacaaaatcttccttcagcttaatctctcccactctaggttcccacgccaccccaatcccactcgaagcagccctgagaaacatcgcccattatctctccataccacccccaaaaattttcgctgtcccaacactttaccactatttcgttttatttttcttattaatataagaagacaggaatgtcaggcctctgagcccaagctaagccatcatatccccgtgacctgcacgtacacatccagatggccagttcctgccttaactgatgacattccaccacaaaagacgtgaaaatggcctgttcctgccttaactgatgacattgtcttgtgaaattccttctcctggctcatcctggctcaaaagctcccccactgagtaccttgtgacccccactcgtgcccgccagagaacaaccccccttcttcctttacctacccaaatcctgtaaaaccccatctcccttcgctgactctcttttcagactcagcccgcctgcacccaggtgaaataaacacccatgttgctcacacaaagcctgtttagtagtctcttcacatggacatgcatgaaa

SEQ ID NO: 80 - DNA, 1627 bp, Homo sapiens
agtgttccatctgctattctactactcctcagggattattcaggccccctcctttccctacacatcaagctcgaggatttgccccacccaggactgacaaattagctttactcaacatgtcccgagtcagataactgaaatacctcttagtctaggtagatactttcactggataggtagaggcctttcctacagggtctgagaaggccaccgcagtcatttcttccgttctgtcagacataattcctcagtttagccttcccacctcaatacagtctgataacagacgagcctttattagtcaaatcagccaagcagtttttcaggctcttagtattcagtgaaacctttatatcccttacggtcctccgtcttcaagaaaagtagaatggactaaaggtcttttaaaaacacacctcaccaagctcagccaccaacttaaaaaggactggacaatacttttaccactttcccttctcagaattcaggcctgtcctcggaatgctacaggatacagcccatttaagctcctgtatagacgctcctttttattaggccccagtctcattccagacaccagaccaacttagactgtggcccaaaaaacttgtcatccctactatcttctgtctagtcatactcctattcagcgttctcaactactcatacatgccctgctcttgtttacactgccggtttacactgtttctccaagccaccacagctgatatctcctggtgctatccccaaactgccactcttaactcttgaagtaaataaataatctttgctggcaggactatgctgaatctccttaggcactctctaatcagatgtcctgagtcatcccaattcttaaaccttttatgcctgtttttctccttctgttattccatttagtttttcaattcgcacaaaaccgtatccaggccatcaccaatcattctatacgacaaatgtttcttctaacatccccacaatatcaccccttaccacaaggcctcccttcagcttaatctctcccactctaggttcccacgccacccctaatcccgcttgaagcagccctgagaaacatcgcccattctctctccataccaccccccaaaaattttcgctgccccaacacttcgacactattttgttttatttttcttattaatataagaaggcaggaatgtcaggcctctgagcccaagccaagccatcgcatcccctgtgacttgcacctatacgcccagatggcctgaagtaactgaagaatcacaaaagaagtgaatatgccctgccccaccttaactgatgacattccaccacaaaagaagtgtaaatggccggtccttgccttaagtgatgacattacctgtgaaagtccttttcctggctcatcctggctcgaaaacaccgccactgagcaccttgcgacccccactcctgcccgccagagaacaacccccctttgactgtaattttcctttacctacccaaatcctgtaaaacggccccacccctatctcccttcactgactctcttttcggactcagcccacctgcacccaggtgattaaaagctttattgctcacacaaagcctgtttggtggtctcttcacacggatgtgcatgaaa

SEQ ID NO: 81 - DNA, 3333 bp, Homo sapiens
gtcggcctctgagcccaagccaagccatcgcatcccctgtgacttgcacgtatacgcccagatggcctgaagtaactgaagaatcacaaaagaagtgaatatgccctgccccaccttaactgatgacattccaccacaaaagaagtgtaaatggccggtccttgcttcaagtgatgacattaccttgtgaaagtccttttcctggctcatcctggctcaaaaagcacccccactgagcacctttcgacccccactcctgcccgccagagaacaaagcccctttgactgtaattttccattaccttcccaaatcctataaaacggccccacccttatctccctttgctgactctcttttcggactcagcccgcctgcacccaggtgaaataaacagccatgttgctcacacaaagcctgtttggtggtctcttcacacagacgcgcatgaaatttggtaatcaggtaagcggcctcttcttactctcttctccaacctctctcactgtccctcaaccactttctcctttccactcttcaatctctcccttctcttaatttcaattcctttcattttcttggagagacaaaggagacacgttttatccgtggacccaaaactccggcgccggtcatggactgggaaggcagccttcccttggtgtttaatcattgctgggacacttctctgattattcacccacatttcaaagatgtcagaccacgcagggacgcctgccttggtccttcacccttagcggcaagtcccgctttcctggggcaggggcaagtacccctcaaccccttctccttcacccttagtggcaagtcccgctttcctaggaggcaagaacccccagtcgtttatttctgcaccccaacctcttatctctgtgccccaatcccttatttctgtaccctgacctcttatctctgtgccccaatcccttatttccgtgccccaaccccttctctgcttttctggagggcaggaaccctccaccccttctccgtgtctctactcttttctctggacttgcctccttcgctatgggtaagcttccaccttccattcctccttcttccttagcctgtgttttcaaaaacttaaaacctcttcaactcacacctgacctaaaacctaaatgccttttcttctgcaatgccacttgaccccaatacaaactcgacagtagttccaaatagccagaaaatggcactttgaatttttccatcctgcaaaatctaaataattcttgtaaaataggcaaacggtctgaggtgcctgacatccaagcattcttttacacatcagtcccttcctagtctctgtgcccagtgcaactcgtcccaaatcttccttctttccctcccgcctgtcccctcagtaccaactccaagcgtcgctgaggctttctaatcttccttttctacagacccatctgacctctcccttcctccccaggctgctcctcgccaggccgagctgggtcccaattcttcctcagcctccgctcctccaccctataatctttgtatcacctcccctcacacctggtccggcttacagtttcggcccgtgactagccctcccccacctgcccagcaatttacttttaaaacggtggctggcgccaaaggcatagtcaaggttaatgctcctttttctttatcccaaatcagaagcgtttaggttctttttcatcaaatataaaaatccagcccagttcataacttgtttggtagcaaccctgagacactttacagccctagaccctaaaacgtcaaaaggccgtcttattcttaaaatacattttattacccaatctgctcccgacattaaataaaactccaaaaattaaattccagccctcaaaccccacaacaggatttaattaacctcgccttcaaggtgtagaataatagaaaaaagttgcaattccttaccttcactgtgagacaaaccccagccacatctccagcacacgagaacttccaaacgcctgaaccgcagcggccaggtgttcctccagaacctcctcccacaggagcttgctacacgtgccggaaatctggccactgggccaaggaatgcccgctgcccgggattcctcctaagccgcgtcccatctgtgtgggaccccactgaaaatcggactgttcaactcacctggcagccactcccagagcccctggaactctggcccaaggctctctgactgactccttcccagatcttctcggcttagcggctgaagactgacactgcccgatcgcctcggaagccccctagaccatcacgaacgccgagctttgggtaactctcacagtgaaaggtaagcccgtccccttcttaatcaatatggaggctacccactccacattaccttcttttcaagggcctgtttcccttgcctccataactgttgtgggtattgacggccaggcttctaaacctcttaaaactccccaactctagtgccaactcagaaaatactcttttaagcactcctttttagttatccccacctgcccagttcccttattaggctgagacactttaactaaattatctgcttccctgactattcctggactacagctatatctcattgctgcccttcttcccaatccaaagcctcctttgcgtcctcctcttgtatccccccaccttaacccacaagtataagatacctctactccctccttggcgactgatcatgcaccccttaccatctcattaaaacctaatcacccttaccccactcaacgccaatatcccatcccacagcacgctttaaaaagattaaagcctgttatcactctcctgctacagcatggccttttaaagcctataaactctccttacaattctcccattttacctgtcctaaaaccagacaagccttacaagttagttccggatctgtgccttatcaaccaaattgttttgcctatccaccctatggtgccaaacccatatcctctcctatcctcaatacctgcctctataacccattattctgttctagatgtcaaacatgctttctttactattcctttgcacccttcatcccagcctctctccactttcacttggactgaccctgacacccatcaagctcagcaaattacctaggctgtactgctgcaaagcttcacagacagcccccattacttccatcaagcccaaatttcttcctcatctgttacctatctcggcataattctcataaaaacacacgtgctctccctgccaatagtgtccgactgatctctcaaaccccagcaccttctacaaaacaacaactcctttccttcctaaacatggttag

SEQ ID NO: 82 - DNA, 941 bp, Homo sapiens
gtggggaaaagcaagagagatcagattgttactgtgtctgtgtagaaagaagtagacataggagactccattttgttctgtactaagaaaaattcttctgccttgagattctgttaatctataaccttacccccaaccctgtgctctctgaaacatgtgctgtgtcaactcagagttaaatggattaagggcggtgcaagatgagctttgttaaacagatgcttgaaggcagcactctccttaagagtcatcaccactccctaatctcaagtacccagggacacaaaaactgtggaaggccgcagggacctctgcctacgaaagccaggtattgtccaaggtttctccccatgtgatagtctgaaatatggcctcgtgggaagggaaagacctgaccgcccccaagcccgacacccgtaaagggtctgtgctgaggaggattagtataagaggaaggcatgcctcttgcagttgagacaagaggaaggcatctgtctcctgcccatccctgggcaatggaatgtctcggtataaaacccgattgtatgttccatctactgagatagggaaaaaccgccttagggctggaggtgggacctgcgggcagcaatactgctttgtaaagcattgagatgtttatgtgtatgcatatctaaatgcacagcacttaatcctttaccttgtctatgatgcaaagacctttgttcacgtgtctgctgaccctctccccacaattgtcttgtgaccctgacacatccccctcttcgagaaacacccacgaatgatcaataaatactaagggaactcagaggctggcgggatcctccatatgctgaacgctggttcagcatactttgtctttgtgtctttttctttcctaagtctctcgttccaccttacgagaaacacccacaggtgtggaggggcaacccacccctaca

SEQ ID NO: 83 - DNA, 690 bp, Homo sapiens
ttatagtaggtagtcagacatgagcagggcaggagagggctcccccaaaactaggaatgtcaggtgaccatcaggtgatggtcaggtgattgttaaactgtctctctaaaataataattggttgcagttggcaccagggaatgtctcccaatagatagaaaaacctaaaactggtgatcagcagcttcctgataagatctcaggagctgggctagtgggttcaagcatgtgcactaagaggcaaaatggcagagtttaactggtatatggccttcctctagaacactcaactgataaggaaagaacgcctcatgtgagcatgcttacaacttcagtaaacgtactgtgcatacggcccctcccaaatgctggcaggccagtgcacatgtggacagcccaccccaagggaagaatcaagagagaagagatgcaaacccccagaagcgtgccaacatataaaaccccaagtcgaaggtcaaaccatgcatttgaacctctcaagtcgcctgcttggtcttcttacaagtatacgttacatccttttgttcctacactaaaacttcttcagaaactttcactcctcctctaaaacttgcctcagtctttccctttgccttatgaccctccatcgaattctttcttctgaggagtcgagaattgaggttgctgcagacccgtacagatttgcca

SEQ ID NO: 84 - DNA, 635 bp, Homo sapiens
caacagcaacaagctttcatgagttaaaagaaaaactcatgtcggccctagccctgaggctacctgacctgacaaaaccctttacactctgtgtgtcagaaagagaaaaaatggcagctggagttttaacccagactgtggggccctggccaaggccagtggcctatctctcaaaacaactagacggggtttccgaaggctggcccccatgtctaagggccctagcagcaatggtcctgttagcacaagaagcagataaactaacccttgggcaaaacctgaatataaaggccccccatgctgtggtaactttaatgactaccaaaggacatcattggttaacaaatgctagattaaccaagtaccaaagcttgctatgtgaaaatcccctcataaccattgaagtttgcaacaccctaaaccccaccatcttgctcccggtatcagagagcccagttgaacatcactgtgtagaggtgttaggcttagtttattctagcaggctcaacttccgagaccatccttaaacatcagtagactgtgagcagtacatggacgggagcagattcgccaacccctgcaaagtgactctgaagaagacgacaagccctgctccagtcacacccggaggctga

SEQ ID NO: 85 - DNA, 5208 bp, Homo sapiens
gtcaggcctcttagcccaagccaagccatcgcatcccctgtgatttgcacatacacacccagatggcctgaagtaactgaagaatcacaaaagaagtgaaaaggccctgccccgccttaactgatgacattccaccattgtgatgtgttcctgccccactttaactgagtgattaaccctgtgaatttccttctcctggctcagaagctcccctactgagcaccttgtgacccctgcccctgcccaccagagaacaaccctctttgactgtaattttccattaccttcccaaatcctataaaacggccccacccttatctccctttgctgactctcttttcggactcagcccgcctgcacccaggtgaaataaacagccatgttgctcacacaaagcctgtttggtggtctcttcacacggacgtgcatgaaatttggtgctgtgacatggatcgggggacctcccttgggagatcaatcccccgtcctcctgctctttgctccgtgagaaagatccacctacgacctcaggtcctcagacctaccagcccaagaaacatctcaccaatttcaaatccggtaagcggcctctttttactctcttctccaacttccctcactatccctcaacctctttctcctttcaatcttggcgctacacttcaatcactcccttctcttaatttcaattcctttcattttctggtagagacaaaagagacacgttttatctgtggaccccaaactccggcgccggtcacggactgggaaggcagccttcccttggtgtttaatcattgcagggatgcctctctgattatacacccacgtttcaagggtgtcagaccatgcagggacgcctgccttggtccttcacccttagcggcaagtcccgcttttctggggaaggagcaagtaccccaaccccttctctccttgtctctaccccttctctgcctttcctggggcgggggcaagtacccctcaaccccttctccttcaaccttagcggcaagtcccgctttcctggggcaggggcaagtacccctcaaccccttctccttcacccttagtggcaagtcctgctttcctggggcaggggcaagtacccctcaaccccttctccttcacccttagcagcaagtcccgctttcctagggggcaagaaccccccaatcgcttatttccacaccccaacctcttatctctgtgccccaatcccttatttctgcaccctgacctcttatctctgtgccccaatcccttatttccgcgccctaacctcttatctctgtgccccaatcccttatttccgtgccctaaccccttctctgcttttctggagggcaagaaccccccaccccttctccgtgtctctactcttttctctgggcttgcctccttcactatgggtaagcttccaccttccattcctccttcttctcccttagcctgtgttctcaaaaacttaaaacctcttcaactcacacctgacctaaaacctaaatgccttattttcttctgcaatgccgcttgaccccaatacaaactcaacagtagttccaaatagccagaaaacggcactttcaatttttccatcctacaagatctaaataattcttgtcctaaaatgggcaaatggtctgaggtgcctgacgtccaggcattcttttacacatcagtcccttcctagtctctgtgcccagtgcaactcgtcccaaatcttccttctttccctccctcctgtcccctcagtcccaaccccaagcatcactgagtctttctaatcttccttttctacagacccatctgatctctcccctccttgccagcccaagctaggtcccaattcttcctcagcctccgctcctccaccctgtaatctttttatcgcctcccctcctcacacctggtctggcttacagtttcattctgtgactagccctcccccacctgcccagcaatttactcttaaaaaggtggctggagccaaaggcatagtcagggttaatgctcatttttctttatcccaaatcagttagcgtttaggctcttcttcatcaaatataaaaacccagcccagttcatggctcgttcggcagcagccctgagacgctttacagccctagaccctaaaaggtcaaaaggccgtcttattctcaatatacattttattacccaatctgctcccgacattaaataaaactccaaaaattaaattccggccctcaaaccccacaacaggatttaattaacctcgccttcaaggtgtacaataatagaaaaaagttgcaattccttgcctccactgtgagacaaaccccagccacatctccagcacacaagaacttccaaacgcctgaaccgcagcggccaggtgttcctccagaacctcctcccacaggagcttgctacacgtgccggaaatctgaccaccaggccaaggaatgcccgcagcccaggattcctcctaagccgtgtcccatctgtgcgggaccccactggaaatcgcactgtccaactcacctggcagccactcccagagcccctggaactctggcccaaggctctctgactgactccttcccagatcttctcggcttagcagctgaagactgacactgcccgatcgcctcggaagccccctagaccatcacggacgccgagctttgggtaactctcacagtggaaggttaagtccgtcccgttcttaatcaatacggaggctacccactccacattaccttcttttcaaggcctgtttcccttgcctccataactgttgtgggtattgacagccaggcttctaaacctcttaaaacttcccaactctggtgccaacttagacaacactcttttatgcactcttttttagttatctccacctgcccagttcccttattaggccgagatattttaaccaaattatctgcttccctgactattcctggattatagccacatctcattgctgcccttcttcccaatccaaagcctcctttgcgtcctcctcttgtattcccccaccttaacccacaagtataagatacctctactccctccttgtcgaccgatcatgcaccccttaccatctcattaaaacctaatcacccttacccctctgaatgccaatatctcatcccacagcatgctttgaaaagattaaagcctgttatcactcgcctgctacagcatggccttttaaagcctataaattctccttacaattcccccattttacctgtcttaaaaccagacaagccttacaagttagtccaggatctatgccttatcaaccaaattgttttgcctatccaccccatggtgccaaacccatatactctcctatcctcaatacctccctccacaatccattattctgttctggatctcaaacgtgctttctttactattcctttgcacccgtcatcccagcctctcttcgctttcacttggactgaccctgacacccatcaggctcagcaaattacctgggctgtaccgccgcaaagcttcacagacagcccccattacttcagtcaagcccaaatttcatcctcatctgttacctatcttggcataattctcgtaaaaacacacgtgctctccctgctgatcgtgtccagctgatctcccaaacctcaatcccttacaaaacaacaactcctttccttcctaggcatggttagtgcggtcagaattcttacacaagagccaggaccgcaccctatagcctttctgtccaaacaacttgaccttactgttttagcctagccctcatgtctgcctgcagcggctgccgctgctttaatacttttagaggcctttcctacaaggtctgagaaggccacggcagtcagttcttcccttctgtcagacataattcctcagtttagccttcccacctctatacagtctgataacagaccagcttttattagtcaaatcagccaagcattttttcaggctcttagtattcagtgacagactaatggtctattaaaaacacacctcaccaagctcagccaccaacttaaaaaggactggacaatacttttaccactttcccttctcagtagtcagacctgtcctcagaatgctacaaggtacagcccatttgagctcctgtatagacgctcctttttattaggccccagtctcattccagacaccagaccaacttcgactgtgcccccaaataacttgtcatccctactatcttctgtctagtcatactcctattcaccgttctcaactactcatacatgccctgctcttgtttacactgccggtttacactgtttttccaagccgtcacagctgatatctcctcgtgctatcctcaaactgccactcttaactcttgaagtaaataaataatctttgctggcaggactatgctgaacctccgtaggcactctctaattagatgtcctaggtcctcccaattcttagtccttttatacctgtttttctccttctcttattccatttagtttttcaattcatacaaaaccgtatccaggccatcaccaataattctacatgacaaatgtttcttctaacatccccacaatatcaccccttaccacaagatctcccttcagcttaatctctcccactctaggttcccacgccgcccctaataccgcttgaagcagccctgagaaacatcgcccattctctctccataccaccccccaaaaattttcgccgccccaacacttcaacactattttgttttatttttcttattaatataagaaggcaggaatgtcaggcctctgagcccaagccaagccattgcatcccctgtgacttgcacgtatatgcccagatggcctgaagtaactgaagaatcacaaaagaagtgaaaaggtcctgccccgccttaactgatgacattccaccattgtgatgtgttcctgccccactttaactgagtgattaaccctgtgaatttccttctcctggctcagaagctcccctactgagcaccttgtgacccctgcccctgcccaccagagaacaaccctctttgactgtaattttccattaccttcccaaatcctataaaacggccccacccttatctccctttgctgactctcttttcggactcagcccgcctgcacccaggtgaaataaacagccatgttgctcacacaaagcctgtttggtggtctcttcccacggacgcgcatgaaa

SEQ ID NO: 86 - DNA, 3389 bp, Homo sapiens
gtcaggcctctgagcccaagccaagccattgcatcccctgtgacctgtacatatatatccagatggcctgaagtaactgaagatccacaaaagaagtaaaaatagccttaactgatgacattccaccattgtgatttgtttccgccccaccctaactgatcaatgtactttgtaattctccccacccttgagaatgtactttgtgagatccacccctgcccgcaaaacattgttcttaacttcaccgcctatcccaaaacctataagaactaatgataatccaccaccctttgctgactctctttttggactcagcccacctgcacccaggtgaaataaacagccatgttgctcacacaaagcctgtttggtggtctcttcacacagacgcgcatgaaatttggtgccgtgactcagattgggggacctcccttgggagatcaatcccccgtcctcctgctctttgctccatgagaaagatccacctacgacctcaggtcctcagaccgaccagcccaagaaacatctcaccaatttcaaatccggtaagtggcctctttttactctcttctccaacctccctcactatccctcaacctctttctcctttcattcttggcgccacacttcaatctctcccttctcttgatttcaattcctttcattttctggtagagacaaaggagacacattttatctgtggacccaaaactccggcgctggtcacggactgggaaggcagccttcccttggtgtttaaccattgcagggacgcctctctgatcattcacccacgtttcagcggtgtcagaccacgcagggatgcctgccttggtccttcacccttagcagcaagtcccacttttctgggggaggggcaagtaccccagctccttctctccatgtctctaccccttctctgattttctggggcagaggcaagaaccccccaaccccttctccttcacccttagcagcaagtcctgcttttctgggggaggggcaagtaccccaaccttgtatctctgcaccccaatcccttatttccatgccccaacccctttcccgcttttctggagggtaagaacccccaaaccccttccctccatgtctctatgctcccttttctctgggcttgcctccttcactatgggcaaccttcctacattcctccttcttctcccttagcctgtgttctcaagaacttaaaacctcttcaactcacacctgacctaaaacctaaatgccttattttcttctgcaatgccgcttgacccaatacgaactcgacagtagttccaaatagccagaaaatggcactttgaatttttccatcctgcaagatctaaataattcttgtcataaaataggcaaacggtctgaggtgcctgacgtccaggcattcttttacacatcagtcccttcctagtctctgtgcccagtgcaactcgtcccaaatcttccttcccctcagtcccaaccccaagcgtcactgagtctttctaatcttccttttctacagacctatctgacctctcccctccttgccaggccgagctaggtcccaattcttcctcagcctccgctcctccaccctataatcctatcacctcccctcctcacaccaggtctggcttacagtttcgttctgtgggaggccccacctgcccagcaatttattcttaaaaaggtggctggagctaaaggcatagtcaaggttaacactcctttttctttatcccaaatcagatagcgtttaggctctttttcatcaaatataaaaatccagcccagttcatgacttgttcggcagcaaccctgagacactttacagccctagaccctaaaaggtcaaaaggccgtcttattctcaaaatacattttattacccaatctgctcccgacattaaataaaactccaaaaattaaattctgaccctcaaaccccacgacaggatttaattaacctcgccttcgaggtgtacaataatagaaaaaagttgcaattccttgcctccactgtgagacaaaccccagccacatctccagcacacaagaacttccaaaggcctgaactgcagcggccaggcgttcctccagaacctcctcccccaggagcttgctacaagtgccagaaatctgaccaccaggccaaggaatgcctgcagcccaggattcctcctaagccgtgtcccatctgtgcgggaccccactggaaatcggactgttcaactcacctggcagccactcccagagcccctggaactctggcccaaggctctctgactgactccttctcggcttagcggctgaagactgacgctgcccgatcgcctctgaagctccacagaccatcacggacaccgagctttgggtaactctcacagtggagggtaagtccatcccctgtttaatcgaaaccgggactatgcactccacgttgcctacttttcaagggcctgtttcccttgcctccataactgttgtgggtattgacggccaagcttctaaacccctgaaaactcccccactcttgtgccaacttggacaacactcttttatgcactgctttttagttatccccacctgcccagttcccttattaggccgagatattttaaccaaattatctgcttccctgactattcctggactacagctacatctcattgctgcccttctccccaacccaaagcctccttcgcgtcttcctctcatatcccccccaccttaacccacaagtatgggacatctctactccttccctggcaactgatcacatgcccgttaccatcccattaaaacctaatcacccttaccccgctcaacgccaatatcccatcccacagcacgctttaaaaggattaaagcctgttatcactcgcctgctacagcatgggcttctaaaacctataaactctccttacaattcccccattttacctgtccaaaaactggacaagtcttacagattagttcagaatctgcgccttatcaacaaaattgtttcacctatccatcctgtggtgcccaacccgtacactcttttgtcctcaataccttcctccacaactcactattccgttctcgatcttaaagatgcttttttcactattcccctgcacccctcgtcccagcctctctttgctttcacttagactgaccctgacacccattaggctcagcaaattacctgggctgtactgctgcaaggcttcatagacagcccccattacttcagtcaagcccaaatttcatcctcatctgttacctatctcggcataattatcataaaaacacgtgctctccctgctgatcgtgtccgattaatctcccaaacctcaatcccttacaaaacaacagctcctttccttcctagccatggttag

SEQ ID NO: 87 - DNA, 5722 bp, Homo sapiens
gtcaggcctctgagcccaagccaagccatcgcatcccctatgacatgcacgtacacgcccagatggcctgaagtaactgaagaatcacaaaagaagtgaatatgccctgccccaccttaactgatgacattccaccacaaaagaagtgtaaatggccagtccttgccttaactgatgacattaccttgtgaaagtccttttcctggctcatcctggctcaaaaagcacccccactgagcaccttgcgaccccccgctcctacccgccagagaacaaaccccctttgactgtaattttcctttacctaaccaaatcctataaaacggccccacccttatctcccttcgctgactctcttttcggactcagcccgcctgcacccaggtgaaataaacagcctcgttgctcacacaaagcctgtttggtggtctcttcacacggacgcgcatgaaatttggtgccgtgactcggatcgggggacctcccttgggagatcaatcccctgtcctcctgctctttgctccgtgagaaagatccacctacgacctcaggtcctcagaccaaccagcccaagaaacatctcaccaatttcaaatccggtaagcggcctctttttactctgttctccaacctccctcactatccctcaacctctttctcctttcaatcttggcgccacacttcaatctctcccttctcttaatttcaattcctttcattctctggtagagacaaaagagacatgttttatccgtgaacccaaaactccggcgccggtcacggactgggaaggcagtcttcccttggtgtttaatcattgcagggacgcctctctgatttcacgtttcagaccacgcagggatgcctgccttggtccttcacccttagcggcaagtcccgctttcctggggcaggggcaagtacccctcaaccccttctccttcacccttagcggcaagtcccgcttttctggggcaggggcaagtacccctcaaccccttctccttcacccttagcagcaagtcccgctttcctagggggcaagaaccccccaatcgcttattttcacgccccaacctcttatctctgtgccccaatcccttatttccacgccccaatctcttatctctgcgccccaatcccttatttccgcgccccaaccctttctctgcttttctggaggggaagaaacccccaccccttctccgtgtctctactcttttctctgggcttgcctccttcactatgggcaagcttccaccttccattcctttcttctcccttagcatgtattcttaagaacttaaaatctcttcaattctcacctgacctaaaatctaagcgtcttattttcttctgcaatgccacttgaccccaatacaaactcaacagtagttccaaatagccagaaaatggcactttcaatttttccaccctacaagatctaaataattcttggcgtaaaatgggcaaatggtgtgaggtgcctgacgtccaggcattcttttacacatcagtcccttcctagtctctgtgcccagtgcaactcgtcccaaatcttccttctttccctcccgcctgtcccctcagtaccaaccccaagcgtcactgagtctttctaatcttccttttctacagacccatctgacctctcccttcctccccaggctgctccttgccaggccgagctaggtcccaattcttcctcagcctctgctcctccaccctataatctttttatcacctcccctcctcacacctgctccggcttacagtttcattccgtgactagccctccccgacctgcccagcaatttattcttaaaaaggtggctggagctaaacgcatagtcaaggttaatgctcctttttctttatcccaaatcagatagtgtttaggctctttttcatcaaatataaaaatctagcccagttcatggctcgtttggcagcaaccctaagacactttacagccctagcccctaaaaggtcaaaaggccatcttattctcaatatacattttattacccaatctgctcccgacattaaataaaactccaaaaactggaatctggccctcaaaccccacaacaggacttaattaacctcaccttcaaggtgtgaaataacagaaaaaagttgcaattccttgcctccactgtgagacaaaccccagccacatctccagcacacaagaacttccaaacgcctgaactgtagcagccagacgtttctccagaacctcctcccccaggaacttgctacacatgccggaaatctggccactgggccaaggaacgcccgcagcccgggattcctcctaagccgcgtcccatctgtgtgggaccccactgaaaatcggactgttcaactcacctggcagccactcccagagctcctggaactctggcccaaggttctctgactgactccttcttggcttactggctgaagactgacgctgcctgatcgcctcagaagccccgcagaccatcatggacgccgagctttaggtaactcacagtggagggtaagtccgtccccttcttaatcaatacggaggctacccactccacattaccttcttttcaagggtctgtttcccttgcctccataactgttgtgagtattgacagccaggcttctaaacctcttaaaactccccaactctggtgccaacttagacaatactctttaaagcactcctttttagttatccccacctgcccagttcccttattaggctgagacactttaactaaattgtctgcttccctgactattcctggactacagctatatctcattgccgcccttcttcccaatcaaaagcctcctttgcgtcctcctcttgtatccccccaccttaacccacaagtataagatacgtctactccctccttggtgaccgatcatgcaccccttaccatctcattaaaacctaatcacccttaccctactcaacgccaatatcccatcccgcagcacactttaaaaaggttaaagcctgttatcactcgtctgctacagcatggccttttaaagcctataaactccccttacaattcccccattttacctgtcctaaaaccggacaagccttacaagttagttcaggatctgtgccttatcaaccaaattgttttgcctatccaccccgtggtgccaaacccgtatactctcctatcctcaatacctccctctactacccattagtctgttctagaactcaaacatgctttctttactattcctttgcacccttcatcccagcctctctttgctttcacttagactcaccctgacactgattaggctcagcaaattacctgggctgtactgccacaaggcttcacagacagcccccattacttcagtcaagcccaaatttcatcctcatctgttacctatctcggcataattctcataaaaacacacgtgctttccctgctgatcgtgtccgattaatctcccaaacctcaatcccttacaaaacaacaactcctttccttcctaggcatggttatagtgcagtcagaattcttacacaagagccaggaccacaccctgtagcctttctgtccaaacaacttgaccttactgttttagcctagccctcatgtctgcgtgcagaggctgccgctgctttaatacttttagaggccctaaaaatcacaaactatgctcaactcactctctacatttctcataacttccaaaatctattttcttcctcatacctgacgcatatgctttctgctccctggctccttcagctgtactcactctttgttaagtcccacaattaccattgttcctggcccggacttcaatccggcctcccacattattcttgataccacacctgacccccacgactgtgtctctctgatccacctgatattcaccccattttcccatatttccttctttcctgttcctcaccctgatcacgcttgatttattgatggtagttccaccaggcctaatcgccacataccagcaaaggcaggctatgctatagtactagccactagcctgcctctcagaacctctcatttcctttccatcgtggaaatctatcctcaaggaaataacttctcagtgttccatctgctattctactactcctcagggattattcaggccccctcccttccctacacatcaagctcagggatttgcccccacccaggactggcaaattagctttacttaacatgcccgagtcaggaaactaaaatacctcttagtctaaatagacactttcactgaataagtaaaggcgtttcctacagggtctgagaaggccaccagtcatttcttccgttctgtcagacataattcctcattttagccttcccacctcaatacagtctgataacagatgagtctttattagtcaaatcagccaagcagtttttcaggctcttagtattcagtgaaacctttatatcccttacagtcctccatcttcaagaaaggtagaatggactgaaggtcttttaaaaacacacctcaccaagctcagccaccaaaaaggactggacaatacttttatcactttcccttctcagaattcaggcctgtcctcggaatgctacaaggtacagcccatttaagctcctgtatagatgctcctttttattaggccccagtctcattccagacaccggaccaacttagactgtgcccccaaaaaaacttgtcatccctactattttctgtctagtcatactcctattttccattctcaactactcatacatgccctgctcttgtttacactgccggtttacactgtttctccaagccatcatagctgatatctcctggtgctatccccaaaccgccactcttaactcttgaagtaaataaataatctttgctggcaggactatgctgaatttccttaggcactctctaatcagatgccctaggtcctcccaattcttagaccttttatacctgtttttctccttcttattccatttagtttttcagttcatacaaaaccgtatccaggccatcaccaatcattctatacaacaaatgtttcttctaacaaccccacaatatcaccccttaccataagatctcctttcagcttaatctctccgactctaggttcccacaccgcccctaatcccgcttgaagcagccctgagaaacatcgtccactctctctccataccactccacaaaaattttccccgccccaacacttcaacactatcttgttttatttttcttattaagaaggcaggaatgtcaggcctctgagcccaagccaagccattgcatcccctgtgacctgcatgtatatgcccagatggcctgaagtaactaaagaatcacaaaagaagtgaatatgccctgccccaccttaactgatgacattccaccacaaaagaagtgtaaatggccagtccttgccttaactgatgacattaccttgtgaaagtccttttcctggctcatcctggctcaaaaagcacccccactgagcaccttgcgacccccgctcctacccgccagagaacaaaccccctttgactgtaattttcctttacctacccaaatcctataaaacggccccacccttatctcccttcgctgactctcttttccgactcagcccgcctgcacccaggtgaaataaacagccttgttgctcacacaaagcctgtttggtggtctcttcacacagacgcgcatgaaa

SEQ ID NO: 88 - DNA, 479 bp, Homo sapiens
ttacagtaggtggctagtcaggcatgaatggggcaagagagggctcccccatcaccccatcagaaaagtcgggtgaccatcaggtgatggtcagacagttgtcacactgcctctaaaataataattggtcgcagccagtgccagggaaaggcagtttccctatagacaggaaaaaactgaaactggtgatcagcagcttcctgatgagatcttaggagctgggcaagtgggctcacacatgtgcactaagaggcaaaacggtggaatttaactggtatatgaccttccgcgcccattccacggcaaaagggaagaatgcctcaggtgagcatgcgtacaactccagtaaacacaccgtgcatgctcccctcccaagcactagcaggccactgtgtatgtggacaacccacaccaagagaagaatcaggggagaaggaacgcaagacccagaatcacgccaacatataaaaccccaagtc

SEQ ID NO: 89 - DNA, 202 bp, Homo sapiens
cccagagatttctttgtttgggaaaataagaccaagggagctaatcaaagccaagccccatgaatacaaaccttagcaggcataactatagccacgagttatctggctgtattggcagccttgagattttgttttgttttgttttgttttgagctgtccttatccctttgtttcattttgaatatgtcttctaataacccaa

SEQ ID NO: 90 - DNA, 959 bp, Homo sapiens
ttagagtaggtgggcaggcaaacatgaacaccacaggagagggctctccctaaggaaccttaggcaaccatctggtgatggtcaggcgctttttaaactctccgtctaaaataataactggtcacagctagcaccagggaaaggcggtctcccaatagatacaaaacacctgaagctggttatcagcagcttcccaataagatcttaggagctgagtgagtgtgctcacccatgcacactaagatgcaaaatggcggagtttaactggtatatgacatccctccaggaagcctggactggtaagggcaaaaatgcctcaaatgagcatgtgcacaacttcagtaaacacactgcgcatgcgacccctcccaagtgctggcaggcactgcgcacgcggacagtccaccccaaggaataatcaagggaggagagactcaaaactccatttggatctctgaagtcacctgcttggtcctcttccaagtgtactttacttttttttactgctctaaagcttttctttttttttcaaaaaaaatttgagacagaacctcactctgtcgtccaggctggagtgaaatggcatgatgttggctcattgcagcctctgccttccgggtttaagcaattctcctgcctcagccttcggagtagctgggattaaagacacacaccacaacgcccagctaatttttgtgttttttagtagtgttggggggtctcaccatgttggccaggctagtctggctagtctggcctcaaatgatccgcctgcctcggcctcccaaagtgctgggattacaggtgtgagccaccacgcctggcccctgctctaaagctttttaataaacttccattcctgctctaaaacgtgccttggtctctcactctgccttgactcttagactaattatttcctctgaggaggcaagaatcgagttgctgcagacctatacaga

SEQ ID NO: 91 - DNA, 1668 bp, Homo sapiens
tctgagcaaggccgtacttccaaaggaagtggagtctcactgcaacagccatcacaaggcatcagatctcactgctcaaggcaacgcttatgctgataaggtagctaaaaagcagctagcattctaacttctatccttcatggcagtttttctccttctcatctggtcactcccacctactcccccactgaaacttccgcctatcaatctcttcccacacaaggcaaatggttcttggaccaaggaaaatatctccttccagcctcacaggcccattctattctgtcgtcatttcataaccacttccatgtaggttacaagctgctaacccgtctcttagaacctctcatttcctttccatcgtggaaatctatcctcaaggaaatcacttctcaatgttccatctgctattctactaccctgcagggattgttcaggccccctcccttccctacacatcaagctcggggatttgccccgccgaggactggcaaattgactttactcacatgcttcaagtcaggaaactaaaatacctcttggtttgggtagacatttcactgggtgggtagaggcctttcccacagggtctaagaaggccaccgcggtcatttcttcccttctgtcagacataattcctcagtttggccttcccacctcctctctttccttgaaaatcactgaagcctcgacttactcactgctgaaaaaggaggactttgtatatttttaaatgaagagtgttgtttttacctaaatcaatctggcctggtatatgacaacataaaaaaacttaaggatagagatagagcccaaaaactctccaaccaagcagacaacaacgttgaacccccttggacactctctaattggatgtcctgggtactcccaattcttagtcctttaatacctatttttctccttcttttattcggaccttgtgtctttcatttagtttctcaattcatacaaaactgcatccaggccatctccaataattctatacgacaaatgctccttctaacaaccccacaatatcaccccttacccccaaatctttcttcagttgaatctctcccactgtgggttcccacgccgcccctaatctcgctcgaagcagccctgagaaacatcgcctattatctctccataccacccccaaaaattttcgctgccccaacactttaccactattttgttttatttttcttattaatataagaagacaggaatgtcaggcctctgagcctaagctaagccatcatatccccagtgacctgcacatatacatccagatggcctgaagcaactgaagatccacagaagtgaaaatagccttaactgataacattccaccattgtgatttgtttctgccccaccctaactgatcaatgtactttgttgatcagtaatctcccccacccttaagaaggttctttgtaattctccccacccttgagaatgtactttgtgagatccaacccctgcccccaaaatattgctcttaactccaccgcctatcccaaaacctataagaaccaatgataatcccaccaccctttgctgactcccttttcggactcggcccgcttgcacccaggtgaaataaacagctgtgttgctcacacaaagcctgtttggtagtctcttcacacggacatgtgaaa

SEQ ID NO: 92 - DNA, 235 bp, Homo sapiens
cttgcaacttagctcagacccgaccaatcaggtaggaaagagagctcactaaaatgctaattaggcaaaaacaggaggtaaagaaatagccaatcatctattgcctgagagcaccgcacgagggacaatgatcgggatatacacccaggcattcaagctggcaatggccaccttctttggatcccctcccttgtatgggagctctgttttcactctattaaatcttgcaacagca

SEQ ID NO: 93 - DNA, 5856 bp, Homo sapiens
gccaggcctctgagcccaagccaagccatcacatcccctgtgacttgcacatatacgcccagatggcctgaagtaactgaagaatcacaaaagaagtgaatatgccctgccccaccttaactgatgacattccaccacaaaagaagtgtaaatggccagtccttgccttaagtgatgacattaccttgtgaaagtccttttcctggctcatcctggctcaaaaagcacccccactgagcaccttgcgacccccactcctgcctgccagagaacaacccccctttgactgtaattttcccttacctacccaaatcctataaattgccccacccctatctccctttgctgactctcttttcagactcagcccacctgcacccaggtgattaaaagctttattgctcacacaaagcctgtttggtggtctcttcacacggacacacatgaaatttggtgccgtgactcggatcgggggtcctcccttgggagatcaatcccctgtcctcctgttctttgctccgtgagaaagatccacctacgacctcaggtcctcagaccgaccagcccaacgaacatctcaccaattttaaatcaggtaagcggcctcttcttactctcttctccaacctctctcactgtccctcaaccactttctcctttccactcttcaatctctcccttctcttaatttcaattcctttcattttctgggagagacaaaggagacacgttttatctgtggatccaaaactccagcaccggtcacggactgggaaggcagccttcccttggtgtttaatcattgcagggacgcctgattattcacccacgtttcaaaggtgtcagaccatgcagggatgcctgccttggtccttcacccttagcggcaggtcccgcttttctgggaaaggggcaagtaccccaaccccttctctccttgtctctaccccttctctgcttttctgggggaggggcaagtacccctcaaccccttctccttcacccttagcggcaagtcccgcttttctgggggaggggcaagtacccttcaaccccttctccttcactcttagtggcaagtcccacttttctagaggaggggcaagtaccccaacctcgtatctctgcaccccaatcccttatttctgtgccccgaccccttatttctgtgcccctaccccttatttccacgcctcatcccttatttccatgccccatcccttatttctgtgccccatcccttatttccgtgccccaaccccttatctctgtgccccaacccctttttccacttttctggaaggtaagaacccccaaacctcttccctctgtttctctactctcttctctaggcttgcttccttcactataggcaaccttccaccctccattcctccttctactcccttggcctgtgttctcaaaaacttaaaacctcttcaactcacacctgacataaaacctaaatgccttattttcttctgcaatgccgcctgaccccaatacaaactcaacagcagttccaaatagccagaaaatggcactttgactttttccatcctacaagatctaaataattcttgtcataaaataggcaaatggtctgaggtgcctgacatccaggcattcttttacacatcagtcccttcccagtctctgtgcccagtgcaactcgtcccaaatcttccctctttccctcccgcctgtcccctcagtcccaacaccaagcgtcgctgagtctttctaatcttccttttctacagacccatctgacctctcccttcctccccaggctgctcctcgccaggccgagctaggtcccaattcttcctcagcctctgctcctccaccctataatctttttatcacctcctctcctcacacctggtccagcttacagtttcgttccgtgagtagccttccccctcctgcccggcaatttactcttaaaaaggtggctggagctaaaggcatagtcaaggttaatgctcctttttctttatcccaaatcagatagcgtttaggctctttttcatcaaatataataatccagctcagttcatgacttgtttggcagcaaccctgagacactttacagccctagaccctaaaagctcaaaaggccgtcttattctcaaaataatgtcaatctgctcctgacattaaataaaactccaaaaattaaattccggccctcaaaccccacaacaggatttaattaacctcaccttcaaggtgtacaataatagaaaaaagttgcaattccttgcctccactgtgagacaaaccccagccacatctccagcacacaagaacttccaaatgcctgaaactcagcggccaggcgttcctccagaacctcctcccccaggagcttgccacaagtgccagaaatctgaccaccaggccaaggaatgcctgcagcccaggattcctcctaagccgtgtcccatctgtgtgggaccccactgaaaatcggactgttcaactcacctggcagccactcccagaggccctggaactctggcccaaggctctctgactgactccttcccagatcttctcggcttcgcagctgaagactgacactgcccgatggcctcggaagccccctagaccatcacagacgcagagcttcgggtaactctcacagtggaaggcaagcctgtccccttcttaatcaatacggaggctacccactccacattaccttcttttcaagggcctgtttcccttgcctccataactgttgtgggtattgacggccaggcctctaaacctcttaaaactccccaactctggtgccaacttagaaaatactcttttaagcactcctttttagttatccccacctgcccagttcccttattaggctgagacactttaactaaattatctgcttccctgactatccctggactacagctatatctcattgccacccttcttcccaatccaaagcctcctttgcgtcctcctcttgtatccccccaccttaacccacaagtataagatacctctactccctccttggcgaccgatcatgcaccccttaccatctcattaaaacctaatcacccttaccccactcaacgccaatatcccatccggcagcacgctttaaaaagattaaagcctgttatcactcgcctgctatagcatggccttttaaagcctataaactctccttacaattcccccattttacctgtcctaaaaccagacaagccttacaagttagttcaggatctgtgccttatcaaccaaattgttttgcctatccaccctgtgatgccaaacccatatactctcctatcctcaatacctgtctctacaacccattattctgtcctagatctcaaacatgctttctttactattcctttgcacccttaatcccagcctctcttcactttcacttggactgaccctgacacccatcaagctcagcaaattacctaggctgtactgctgcaaagcttcacagacagcccccattacttcaatcaagcccaaatttcttcctcatctgttacctatctcggcataattctcataaaaacacacgtgctctccctgccaatcgtgtccgactgatctctcaaacccaagcaccttctacaaaacaacaactcctttccttcctaggcatggctagcatggtcagaattcttacacaagagccaggaccacaccctgtagcctttctgtccaaacaacttgaccttactgttttagcctagccctcatgtctgcgtgcagcggctgccgctgctttaatacttttagaggccctcaaaatcacaagctatgctcaactcactctctacagttctcataacttccaaaatctattttcttccccatacctgacgcatatactttctgctccccggctccttcagctgtactcactctttgttgagtctcccacaattaccgttgttcccggcccagacttcaatccggcctcccacattattcctgataccacacctgacccccatgactatctctctgatccacctgacattcaccccatttccccaaatttccttctttcctgttcctcaccctgatcacgcttgatttattgacggcagttccaccaggcctaatcgccacacaccagcaaaggcaggttatactatagtacaagccactagcccgcctcttagaacctctcatttcctttccatcgtggaaatctatcctcgaggaaataacttctcagtgttccatctgctattctactactcctcagggattattcaggccccctcccttccctacacatcaagctccaggatttgccccacccaggactggcaaattagctttactcaacatggcctgagtcagataactaaaatacctcttagtctaggtagattctttcactggataggtagaggcctttcctacagggtctgagaaggccactgaggtcatttcttccgttctgtcagacataattcctcagtttagccttcccacctctatacagtctgataacagacgagcctttattagtcaaatcagccaagcagtttttcaggctcttagtattcagtgaaacctttatatcccttacggtcctccgtcttcaagaaaagtagaatggactaaaggtcttttaaaaacacacctcaccaagctcagccaccaacttaaaaaggactagacaatacttttaccactttcccttctcagaattcaggcctgtcctcggaatgctacagggtacagcccatttaagctcctgtatagatgctcctttttattaggccccggtctcattccagacaccagaccaacttagactgtgccccaaaaatcttgtcatccctactatcttctgtctagtcatactcctattcaccgttctcaactactcataccctgctcttgtttacactgccagtttacactgtttttccaagccatcacagctgatatctcctggtgctatccccaaactgccactgttaactcttgaagtaaataaataatctttgctggcaggactatgctgtatctccttaggcactctctaatcagatatcctgagtcgtcccaattcttagaccttttatacctgtttttctccttctgttattccatttagtttctcaattcatccaaaaccgtatctaggccatcaccaatcattctatacaacaaatgtttcttctaacatccccacaatatcaccccttaccacaagacctcccttcagcttaatctctcccactctaggttcccacgctgcccctaatcctgcttgaagtagccctgagaaacatcacccattctctctccaaaccaccccccaaaaatttttgccgccccaacacttcaatactattttgttttatttttcttattaatagaagaaggcaggaatgtcaggcctctgagcccaagcccagccatcacatcccctgtgacttgcacatatacgcccagatggcctgaagtaactgaagaatcacaaaagaagtgaatatgccctgccccaccttaactgatgacattccaccacaaaagaagtgtaaatggccggtccttgccttaagtgatgacattaccttgtgaaagtccttttcctggctcatcctggctcaaaaagcacccccactgagcacattgcgagccccactcctgcccgccagagaacaacccccctttgactgtaattttcccttacctacccaaatcctataaatggccccacccctatctccctttgctgactctcttttcggactcagcccacctgcacccaggtgattaaaagctttattgctcacacaaagcctgtttggtggtctcttcacagggacgcacatgaaa

SEQ ID NO: 94 - DNA, 898 bp, Homo sapiens
gtggggaaaagaaagagagatcagattgttactgtgtctgtgtagaaagaagtagacataggagactccattttgttccctactaagaaaaattcttctgccttgagatgctgttaatctgtaacccttcccccaaccctgtgctccctgaaacatgtgctgtgtcaactcagggttaaatggattaagggctgtgcagggtgtgctttgttaaacaaatgcttgaaggcagcatgcttgttaagagtcatcaccactccctaatctcaaaccactccctaatctcaagtacccagagacacaaaacactgcagaaggccgcagggacctctgcctaggaaagccaggtactgtccaaggtttctccccatgtgagagtctgaaatatggcctcgtgggaagggaaagacctgaccgtcccccagcccgacacccgacacccgtaaaaggtctgtgctgaggaggattagtaaaagaggaaggaacgcctttttgcagttgagataagaggaaggcttctgtctcctgctcatccctgggcaatggaatgtctgggtgtaaagctgattgtatattccatctactgagataggagaagaccgccttagggctggaggtgggacatgctggcagcaatactgttccttaaggcaatgagatgtttatgtatatgcacatcaaaagcacagcacttttttctttaccttgtttatggtgcagagacatttgttcacgtgtttaccttctgacctctccactattatcctattatcctgtcacgcccgataatgagcaataaatactaagggaacgcagcagccggggctggcgtggatcctccatatgctgaatgcctgtcccctgggcccctttttctttttttttttttttttttttt

SEQ ID NO: 95 - DNA, 953 bp, Homo sapiens
gtggggaaaagcaagagagatcagattgttactgtgtctgtgtagaaagaagtagacataagagactccattttgttatgtactaagaaaaattcttctgccttgagattctgttaatctataaccttacccccaaccccgtgctctctgaaacgtgtgctgtgtcaactcagagttaaatggattaagggcggtgcaagatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccgtaaagggtctgtgctgaggaggattagtaaaagaggaaggaatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcattgagatgtttatgtgtatgcatatctaaaagcacagcgcttaatcctttacattgtctatgatgcaaagacctttgttcacgtgtttgtctgctgaccctctccccacaattgtcttgtgaccctgacacatccccctcttcgagaaacacccacaaatgatgaataaatactaagggaactcagaggctggcgggatcctccatatgctgaacgctggttccccgggtccccttatttctttctctatacttagtctctgtgtctttttctttcctaagtctctcgttccaccttacgagaaacacccacaagtgtggaggggcaacccgcccctaca

SEQ ID NO: 96 - DNA, 5119 bp, Homo sapiens
gtcaggcctctgggcccaagcctgcacatatacatccagatggcctgaagtaactgaagaatgacaaaagaagtgaaaatggctggttcctgccttaactgatgacattaccttgtgaaattccttctcctggctcagaagctcccccactgagcaccttgtgacccccgcccctgctcaccagagaacaacccctattgactataattttccactacccacccaaatcctataaaacggcccacccctacctctcttcgctgactctcttttcggactcagcctgcctgcacccagatgattaaaaagctttattgctcacacaaagcctggtggtctcttcacacagatgcacatgaaatttggtgccgtgactcagactgggagacctcccttgggagatcaatcccttgtcctcctgctctttgctccatgagaaagatccacctacgacctcgggtcctcagaccaaccagcccaaggaacatctcaccaattttaaatcgggtaagtggcctctttttactctcttctccaacctctctcactatccctcaacctctttctcctttcaaccttgccgccatccttcaatctctcccttctcttaatttcagttcctttccttttctggtagagacagagaagacacattttatccatgaacccaaaactccggtgctggtaacggactctggaagacagtcttcccttggtgtttaatcactgcggggacgcctgcttgattattcacccatgtttcagaggtgtctgatcactgcagggatgcctgccttgatccttcacccttagtggcaagcaccactttcctggggggcaagcaccccccaacccttctctctgtgtctctaccctctcttttctctgggcttgcatccttcactatagacaaccttccaccctccattcctccttcttctcccttagcctgtgttctcaagaacttaaaacctcttcaactcacacctgacctaaaacctaaatgccttattttgttctgcaatgctgcttaaccccaatacaaactcgacaatggttccaaatagccagaaaatggcactttcgatttttccatcctacaagatctagataattcttgtcgtaaaatgggcaaatggtctgagatgcctgatgtccaggcattcttttacacatcagtccctccctagtctctgttcccaatgcaactcgtcccaaatattccttctttccctcctgcctgtcccctcagtcccaaccctaagcattgctaagtctttccaatcttccttttctatggacccatctgacctctcccctcctccccaggctgctccttgctaggccgagccaggtcccaattcttcctcattctctgctcccccaccctataatccttttatcacctcccctcctcacacctggtccagtttacagttttgttccatgactagccctccctgacctgcccaacaatttcatcttaaagaggtggctggagctaaaggcacagtcaaggttaatgctcctttttctttatccgacctctcccatatcagttagcgtttaggctcctttttatcaaatataaaaactcagcccagttcatggcccgtttggcaacaacccttagatgctttacagccccagaccctgaagggtcagaaggccatcttattctcaatatgcattttattacccaatctgctcccaatattaaataaagctccaaaaattaaattccagccctcaaaccccacaacaggacttgattaacctcgccttcaaggtgtacaataatagagaagagttgcaattacctgcctctgctgtgagaggaaccccagccacatctccagcacacaagaacttcaaaacacctaagccacagtggtcaggcgttccttcaggacctcctcccccaggatcttgctttaagtgctggaaatctggccactgggccaaggaatgcctgcagcccgggattcctcctaaaccatgtcccatctgtgagggaccccactggaaatcggactgtccagcttgcctggcagccactcccagagtccctggaactctagcccaaggctctctgactgactccttcccagatcttctcggcatagcggctgaagactgacactgcccgattgcctcagaagcctcctggaccaacacagactctttcagtaactcttacagtggaaggtaagtccgtccccttcttaatcaatgtggaggctaccaactccacattactttcttttcaagggcctattttctttgcctccataactgttgtgggtattgatggccaggcttctaaacctcttaaaactccccaactctggtgccaacttggacaacattcttttatgcgctcctttttagttatccccacctgcccagctcccttattaggtggagacatttcaactaaattatctgcttccctgactattcctaggctacagccacacctcattgccacccttttccccagttcaaagcttccttcacatcctccccttctatctccccaccttaatccacaagtatgggacacctctactccctccttagcaaccgatcatgcaccccttaccatctcattaaaacctaatcacccttaccccgctcaacaccaatatcccatcccacagtatgctttaaaaggattaaagcctgttatcacttgcctgttacagcatggccttttaaagcctataaactctccttacaattcacccattttacctgtccaaaaaccggacaagtcttacaagttagttcaggatctgtgccttatcaactaaattgttttgcctatccacctcatggtgccaaacccatatactctcctatcctcagtacctccctccacaacccctccacaacccattattctgctctagataaacctagctgaccccacagatcctaaatcctttccccactcccctttccattccttaaaaaacagctcccacactagctctccctaactcatcactcccttttcattacacacagccgaagtgcagggctgtgcggtcagagttcttacacaagagccgggaccacgccctgtagcctttttgtccaaacaacttgaccttagtgttttagcttagctctcatgtctgcgtgcggcggctgccgctgctttaatacttttagaggccctcaaaataaaaaactatgctcaactcactctctacagttctcaaaacttgcaaaatctattttcttcctcacacctgacgcatatactttctgcccccttccaccacctctcagcaagctgaactcattgccttgactcgagccctcactcttgcaaaagactacatgtcaatatttatactgactctaaatatgccttccatatcctgcaccaccatgctgttatataggcaaaaagaagtttcctcactacgcaagggtcctccatcattaatgcctctttaataaaaactcttctcaaggctgctttacttccaaaggaagctggagtcattcactgcaagggccatcaaaaggcatcagatcccatcgctcagggcaacacttctgctgacaaggtagctaaagcagcagctagcttccaacttccgtccctcactgtcagtttttctccttctcatcggtcactcccaaatactcccccactacaacttccacttatcaatctcttccgacacaaggcaaatggtttttggaccaaggaaagtatctccttccggcctcataggcccattctattctgtcattatttcataacctcttccatgtaggttacaagccactagcctgcctcttagaacctctcatttcctttccatcgtggaaatctgtcctcaagaaaatcacttctcagtgttccatctgctattccactcctcctcagggattgttcaggccccctcccttccctacacatcaagctcggggatttgcccctgcccaggactggcaaattgacttaactcacatgccctgagtcaggaaactaaaataccacttggtctgggtagacacttccactggatgggtagaggcctttcccacagggtctgagaaagccactgcagtcatttcttcccttctgtgagacataattccttggtttggccttcccacctctgtacagtctgataacggaccggcctttactagtcaaatctcccaagcagtttctcaggctcttggtattcagtgaaaccttcatgccccttaccaccctcaaccttcaggaaagataaaatggactaatggtcttttaaaaacacacctcacctcacagcctccaacttaaaaaggaggactatattaaggatagaacccaaaaacttgccaacaaagcaagtaattccgctgaacccccttaggcactctctaattggatgtcctgggtcctcccaattcttagtcctttaatatctgtttttctcctattattcggacttcgtgtcttctgtttactttttcaattcatacaaaaccgcatccaggccatcaccaatcattctatacaacaaatgtttcttctaacaaccctacagtattaccccttaccacaaaatcttccttcagcttaatctctcctactctaggttcccatgccgaacctaatcccgctcgaagcagccctgagaaacattgcccattatctctccataccacccccaaaaatgttcgccaccccaacacttcaacagtattttgttttatttttcttattaagaaaacaatgtcaggcctctgggcccaagcctgcatgtatacatccagatggcctgaagtaactgaatgacaaaagaagtgaaaatggccggttcctgccttaactgatgacattaccttgtgaaattccttctcctggctcagaaactcccccactgagcaccttgtgacacccacccctgcccaccagagaacaaccccctttgactgtaatttttccactacccacccaaatcctataaaatggccccacccctatctcccttcactgaccctctttctggactcagcccgcctgcacccaggtgattaaaaagctttattgctcacacaaagcctgtttggtggtctcttcacacagacgtgtgtgaaa

SEQ ID NO: 97 - DNA, 500 bp, Homo sapiens
gtcaggcctctgagcctaagccaagccatcgcatcccctgtgacttgcacgtatatgcccagatggcctgaagtaactgaagaatcataaaagaagtaaaaatgccctgccccgccttaactgatgacattccactacaaaagaagtgtaaatgtccggtccttgccttaactgatgatgttccaccacaaaagaagtgaaaatggccggtccttgccttaagtgatgacattaccttgtgaaagttcttttcctggcccatcctggcttcaaatctcccccactgagcaccttgcaatgcccactcctgcccggcagagaacaacccccctttgactgtaactttcctttatctacccaaatcctataaaacggccccacccttatctcccttcactgactctcttttcggactcagcctgcctgcacccaggtgattaaaagctttatcgctcacacaaagtctgtttagtagtctcttcacaccgacaggcatgaaa

SEQ ID NO: 98 - DNA, 4600 bp, Homo sapiens
gtcaggcctctgagcccaagttaagccatcatatccccagtgacctgcacttatacatccacatggcctgaagcaactgaagatccacaaaagaggtgaaaatagccttaactgatgacattccaccattgtgatttgtttctgccccaccttaaatgatcaatgtactttgtaatctcccccacccttaagaagattctttgtaattctccccacccttgagaatgtactttgtgagattcaccccctgcccgcaaaacattgctcctaactccaccacctatcccaaaacctgtaagaactaatgataatcccaccaccctttgctgactcccttttcaaactcagcccgcctgcacccaggagaaataaacagccttgttgctcacacaaagcctgttggtggactctcttcaccgggatgcgcgtgacaggatccatgatctggaagcctccataaagggatgtgggggtgactggccccaaccttctttctttttttttcctggccacgtagagagactatattccctggctcccatacagataggagtagctgtgtgactaagttcaatggaacatgattgaaaatgatgtgtgcacatccgtaacaacttagcataaccttagttgcttaacacaacataaatttattctcttacttctggaggccggaagtctgaaatgagcttcacagggctcaagtcagagtgttgttggcagggctgcttccttctgaagctctagtggggaattcttgctttttctggcctctggaggccttctgcattccttggcttgtgactcattccttgcatcactccagtgttttcaatcttcatatctccttacttctttatccttgactttcttgcctcgctcttataaggtcattatatttagggctcatccagataatccaggataatctccccattttaagtcccttaatttaatcacagctacaaagtatcttttgcaataaagataacaatcacagattccagagattaagatgtggacatctttagaggccattattctgctgaccacagtgatcctagacactccatctctccatatctgccagctgaatgcagagaatgaggaagccaaagagataggggaagccaaagagtagaaggagcctgtgttgctgaatgaccaggtagagcagagctcccttgctgagtacactggactgtgaaatgaaggagaaaaaaaaattattgtgttaagccactgtggtcttttaaagacacacctcaccaagctcagcctccaacttaaaaatgactggacagtacttttacctattgcccttctcagaattagagcctgtccttgagatgctacagtgtacagtccatttagacttttatatggatgcattttttttttttttttttttgagaccgagtctcgctctgtcacccaggctggagtgcagtggcatgatctcggctcactgcaacctctgcctcccaggttcacgccattctcctgcctcagcctcctaagaagctgggactacaggcgcccgccaccatgcctggctaattttttgtatttttagtagagacggggtttcactgtgttagccaggatggtctcgatctcctgacctcatgatccgcccaccttggcctcccaaagtgctgggattacaggcgtgagccaccacgcctggcctggatgcactttcttactcggccccagcctcgtcccagacaccggccctctaggcggctatcttccagtcctccagtaagctagacaggaaattcaccaggctgctaatcttctcttgcctattccaaattcctagccataagaagacaccctagctggacgatcagttcttgttaagagtctgacccctcaaaccctacaacctcaatggactagaccctacttagtcatctatagtactccaaccgccgtctgcctgcaggaccctccccattgggttcactgttccaggataaagctgtgtccctcggacagccagcctgatatctcctcttcctcctggaagtcacaagtattctcccctacttcccttaaactcatttgcatttctgaagaacagtaataacccttatgagcctaatacatcccttcattctattaggtctatccatccttaccctactctttgcaacaggactttatgcagtcacccccactacttggactgtgccccaaaacttgtcatccctactatattctgtctagtcatactcctattcaccattctcaactactcataaatgacctgctcttgtttacactgccggtttacattgtttctccaagacatcatagctgatatctcctggtgctatccccaaactgccactcttgactccctcttggagtggatagatgatctatggtggcagggcaccccccagtacttccaccctgatgaagttctattctttacttttgtactcactcttattctcattcccattcttatgccactctctacctctccctagttacctccagcatactatcaatctcacccactctctcctcactgtctccaatccttctctagcaaagaattgttggctatgcatttccctttcttcctgcttttacacagccacccccactctataggctgactgggctacctctcccgtctccctgcacctcagaacctccgttaatagccctcatctttactcacctgaggaactcctttactttctagacaggttgggtgagaactccccagatatttcacaccaacaagctgccacacttctctgcatctacttacggcacctttctccttatgtcaattccacccccctatatttggacccctaaccacacaaacaactatccctgttgccgctcctcccaacaacagcctactggaatccctttaggcaaccttccactgtccaaatgttcctttactctttatctccagagcccagccacacacattaccaaacagatgggagcattctgactttgcattactgataagccctctatcattactgacaaactaaaacacattggcagtcactattgtttaggaagacacctaccctgcatctcactccatccttggctacccttcccctgctcatctgaatctcctcctagcccctcctcttgcttgcttatacccagctccatgaatagcagtgaaaggttacttgtagacactatgcgctttctcatacaccatgagaaccgaacccctccctctacacagttgcaccatcaatccccattacaatctctaacagctgctgcccttgctggatctctaggattttgggtgcaggattactctttcagtacaccctctcatcttttcactttacatttccagttctgcctgacaaaaggtctcttctttttatgtggctcttccacctacatgtgcctacctgccaactggacaggcacatgtactctagtcttccttacccccaaaatccagtttgcagatgggaatgaacaactgcctgtccccctcatgatgttaacaggacaaaaaagagtcatcccactaatccctttgcttgtgggtctaggactctctgcctccactattgcacttggaactggaatagcaggcatctcaaccactgtcacaacattctgcagtctctctaatgacttctctgctagcattacagatatatcacaaactttatctgttctccaagcccaggttgactctttacctgcagttgtcctccagaactgccgaggccttgatttactcactgctgagaaaggaggactttgtatatatatatatattttctaattttattattatactttaagttttagggtacaagtacacaacgtgcaggtttgttacatatgtatacatgtgccatgttggggtgctgcacccattaactcatcatttagcattaggtatatctcctaatgctatccctctcccctccccccaggactttgtatatttttaaatgaagagtgttgtttttacctaaagcaatctggcctggtatatgacaacataaaaaaactcaaggatagagcccaaaaactcgccaaccaagcaaacaataacgttgaacccccttggacactctctaattggacgtcctgggtactcccaattcttagtccattaatacctgtttttctccttttactcagaccttgtgtctttcgtttagtttctcaattcatacaaaaccgcatccaagccatcaccaataattctatacgacaaatgctccttctaacaaccccacaatatcaccccttaccccaaaatctttcttcagttgaatctctcccactgtagggtcccacgccacccctaatgcccctggaagcagccctgagaaacatcgcccattatctctccataccaccgccaaaatttttcaccgccccaacactttactgctactttgttttatttttcttattaatataagaagacaggaatgtcagccctctgagcccaagctaagccatcatatccccagtgacctgcacttatacatccacatggcctgaagcaactgaagatccacaaaagaagtgaaaatagccttaactgatgacattccac

SEQ ID NO: 99 - DNA, 3082 bp, Homo sapiens
gtcaggcctctgagcccaagctaagccatcatatcccctgtgacctgcatatatacatccagatggcctgaaacaactaaacatccacaaaataagtgaaaatagccttaactgatgacattccaccattgtgatttgtttctgccccaccctaactgatcaatgtactttgtaatttccctcccttaagaaggttctttgtaattctccccacccttgagaatgtatattgtgagatccaccacctgccagcaaaacattgctcctaactccaccgcctgtcccaaaacctgtaagaactaatgataatcccaccacccttcgctgactcctttttcggactcagcccacctgcacccaggtgaaataaacagccttgctgttcacacaaatcctgttggtggactttcttcacaaggacgcgtgagacatttggtgcagaagacctgggtcagagggactccttcgggagaccagtctcctgtcctcatcctcactccgtgaagagatccacctatgactttgggtcctcagaccaaccagcccaaggaacatctcaccaatttcaaattgggtaagcggtcttttcactctcttctccaggctctctcgctacccttcaatctccctgtccttccaattcctgttctttttcctctctagtagagacaaaggagacacattttatcagtggacccaaaactccggcacaggtcacggactcagaaagacagccttcccttggtgtttaatcattgtggggatgcctgcctgattattcactcacattccattggtgtctgatcaccacggggacgcctgccttggtcattcactcacattcccatggtggtaagtcaattgcgcggacgcctgctttggctgctcacccacattgcagtccagggctactccccaccccacttctccgtgtctctaaccttctctttaaacttgcctccttcactatgggcaaccttccaccctccattcctccttcttctcccttagcctgtgttctcaagaaattaaaacctctccaactctctcctgacccaaaatctaagcgtcttattttcttctgcaatactgtttggccccagtacaaactcgacagtagttccaagtggccagagaatggcactttcgatttgtctatcctacatgatctagataatttttattgaaaaatgggcaaatgatctgaggtgcctgacatccaggccttcttttacgcattggtccctccctactctctgctcccaatgccactgatcccaaatctttattctttctctcctgtctgttccttcagtctccactccaagctctgagacctttgaatccttcttttctacggactcatctgacctctccccttctcccccaggctgctcctcgccaggcctagccacgtcccaattcttcctcagcctctgctcccccaccctaaaatctttctatcacctcccctcctcacacctggtctggcttacagtttcgttctgcgactagccctcccccacctgcccaacaatttcctcttaaagaggtggctggagaatagtcagggttaattctcgtttttcttcatccaacctctcccaaatcagttagcatttaggctctttttcatcaaatataaaaacccagcccagttcatggcccatttggcaacaatccttagacgctttactgtcctagaccccagaagaaggctgtcttattctcaatatgcattttattacccaatccgctcccgactttagaaaaagctccaaaaattagattctggccctcaaaccgcacaacaggacctaactaacctcgccttcaaggtgtacaataatagaatagaggcagccaagtagcaacatatttctgaattgcaattacttgcctccactgtgagagaaatcccagccacatttccagtacacaagaacttcaaaacgtctaaaccgcagtggccaggtgttcctccaggaccgcctcccccaggattttgtttcaagtgctggaaatctggccactgggccaaggaatgcccacaacctgggattcctcctaagctgtgtcccaactgtgagggaacccactggaaatcggactgtccaactctcctggcagccactcccagagaacctgtgactctggcccaaggctctctgactgactccttcccagatctcctcagcttagcagttgaagactgatgctgcctgatcacctcagaagccccctggaccatcaaggatgccgagcttcaagtaactcttacagtggagggtaagtccatcccttgtttaatcgataacgggggctacccactccacattaccttcttttgaagggcctgttttcccttggccccataactgttctgagtattgacagccaagcttcaaaaccccttaaaactcccccactctggtgccaacttggacaacattcttttatgtactctttttcagttatccccacctgcccagttcccttattaggccgagacattttaaccaaattatctgcttccctgattattcctggaccacagccacatctcattgccacccttcttcccaacccagagcctccttcacatcttcctctcatatccccccaccttaacccacaagtatgggacacctccacaccctccctggcaaccgatcacatgcccattactatctcgttaaaacctaatcaccccacccaatgccagtatcccatcccataacaggctttaaggggattaaagcctgttatcacttgcctgctacgccatcggcttctaaaacctataaactctccttacaattctcccattttacctgttcaaaaacgggacaagtcttacaggttagttcaggatctgcgccttatcaacaaaattgttttgcctgtccaccctgtggtgcccaacccgtacactcttttgtcctcaataccttcctctatgactcactattctgttcttgatcttaaagacgcttttttcactatttccctacacccctcgtcccagcctctgtttcttttacctggactgaccctgacacccatcagtcccagcagctta

SEQ ID NO: 100 - DNA, 442 bp, Homo sapiens
cccgaggaaatctcaactgcacgacccctactatgccccagttcagcaggaagcagttagagcagtcatcggccaacctccccaacagcacttgggttttcttgttgagaggggggactgagagacaggactagctggatttcccaggccgactaagaatccctaagcctagctgggaaggtgaccacatccacctttaaacaaggggcttgcaacttagctcacacgtgaccaatcaggtagtaaaaatagctcactcaaatcctaattaggcaaaaacagaagataaagaaatagccactcatctatcgcctgagagcacacggggagggacaatgatcgggatatacccaggcattcgagccagcaacggcaaccccctttgggtcccctcccattttatgggagctctgttttcactctattaaatcttgcaacttca

SEQ ID NO: 101 - DNA, 5556 bp, Homo sapiens
gtcaggcctctgagcccaagctgagccatcatacacctgtgacctgcatatacacatccagatggccggttcctgccttaactgatgacattgtcttgtgaaattccttctcctggctcatcctggctcaaaagctcccctactgagcaccttgtgacccccactctgcccgccagagaacaaccccgctttgactgtaattttcctttatctacccaaatcctataaaacagccccacccttatctccctttgctgactctctttttggactcagcccacctgcacccagatgattaaaagctttattgctcacacaaagcctgtttggtggtctcttaacatggccgcgcatgaaatttggtgccgtgactcggatcgggggacctcccttgggagatcaatcccctgtcctcctgctctttgttccatgaaaaagatccacctatgacctggggtcctcagatccaccagcccaaggaacatctcactaattttaaatcaggtaagcggcctctgtttactctcttctccaacctccctcactatccctcaacctctttctcctttcaatcttggtgccacacttcaatctctcccttctcttaatttcaattcctttcattttctggtagagacagaggagacaggttttatccgtggacccaaaactccggcgccggtcacggactagggaaggcagccttcccttggtgtttaatcattgcagggacacctctctgattattcaccgaggtttcagaggtgtcagaccatgcagggatgcctgccttggtccttcacccttagtggcaagtcccgcttttctgggggagggccaagtaccccaaccccttctctccatgtctctaccccttctccacttttctggggcaggggcaagaacccctcaaccccttctctttcactcttagtggcaagtcccacttttctaggggacaagaacccccaatcccttatttccacgccccgacctcttatctctgcgtcccaaccccttatttctgcaccctgacccctttcccgctttcctggaaggtaagaacctatgaaccccttccctccatgtctctactctctcttttctctgggcttacctccttcactatgggcaaccttccaccctccattcctccttcttctcccttagcctgtgttctcgagaacttaaaacctcttcaactcacacctgacctaaaacctaaatgccttatcttctgcaatgctgcttgaccccaatataaactcgacagtggttccaaatagccagaaaatggcattttcaatttttccatgctacaagatctaaataattcttgtcataaaatgggcaaacggtctgaggtgcctgacatccaggcattcttttatacattgttccctccctagtccctgttcccaatgcgactcatcccagatcctccttctttccctcccacctgtcccctcagtcccaaccccaagcatcgctgagtctttctaatcttccttttctacagacccatctgacctctccccttctcgccaggctgagccaggtcccaattcttcctcagcctctgctcccccaccctataatccttttatcacctcccctcctcacaccgggtccagcttacagtttcgttctgcaactagccttcccccacctgcccagcaatttcctcctaaaaaggtggctggagctaaaggcatagtctttgacctctcccaaaatcagttagcatttaggctctttttcatcacatataaaaacccagcccagttcatggctcatttggcagcaaccctgagacgctttacagccctagaccctgaaaggtcagaaggccgtcttattctcaatatgcattttattacccaatctgctcccgacatgaaataaagctccaaaaattaaattccggccctcaaaccccacaacaggacttaattaacctcaccttcaaggtgtacaataacagagtagaggcagccaagtagcaatgtatttctgagttgcaattccttgcctccactgtgagacaaaccccagccacatctccagcacacaagaactccaaacgcctgaaccgcagctgccaggggttcctccagaaacttcccccaggagcttgctacaagtgccagaaatctggccactgggacaaggaatgcccacagctcgggattcctcctaagctgcgtcccatctgtgtgggaccccactgaaaatcggactgttcaactcacctggcagccacttccagagcccctggaactctggcccaaggctctctgactccttcccagatcttctcagcttagcagctgaagactgacactgcctgatcgcctcagaagcctacaggaccatcacagatgctctagataactctcacagtggagggtaagtccgtccccttcttagtcaatatggaggctacccactccacattaccttcttttcaaggtcctgtttcccttgcctccataactgttgtgggtattgacggccaggcttctaaacctcttaaaactccccaactctggtgccaacttagaaaacattcttttatgcactcttttttagttatccccacctgcccagttcccttattaggccaagacattttaactaaattatctgcttccctgactattcctggactacagctgcatctcattgccgcccttctccccaacccgaagcctcctttgcatcttcctctcgtatcccccaaccttaacccacaagtatgggacatctctactccctccctggcaaccgatcacatgcccattaccatcccattaaaacctaatcacccttaccccactcaatgccaatatcccatcccacagcatgctttaaaaggattaaaacctgttatcactttcctgttacagcatggccttttgaagcctatatactcttcttaccattcccccattttacctgtcctgaaaccagacaaggcttacaggttagttcagaatctgcgccttatcaaccaaattgttttgcctatccaccccttggtgccaaacccatatactctcctatcctcaatacctgcctctacaacccattattctgttctggttctcaaacatgctttctttactattcctttgcacccttcatcccagcctctctttgctttcacttacactgaccctggcacccattaggctcagcaaattacctgggttgtactgccgcaagtcttcacagacagcccccattacttcagacaagcccaaatttcatcctcatctgttacctatctcggcataattctcataaaaacacacgtgctctccctgctgattgtgtccgattaatctcccaaacctcaatcccttacaaaacaactcctttccttcctaggcatggttagtgcagtcagaattcttacacaagagccaggactgcaccctgtagcctttctgtccaaaagacttgactttactgtttagcctagccctcatgtctgtgtgcagcggctgccgctgctttaatacttttagaggccctaaaaatcacaaactatgctcaactcactctctacatttctcataacttccaaaatctattttcttcctcatacctgacgcatacactttctgctccccggctccttcagctatactcactctttgttaagtcccacaattaccattattcctggtccggacttcaatctggcctcccacattattcctgataccacacctgacccccatgactgtatctctctgatccacctgacattcaccccatttccccatatttccttctttcctgttcctcaccctgatcacacttgatttattgatggcagttccaccaggcctaatcaacacacaccagcaaaggcaggttatactatagtacaagccactagcctgcctcttagaacctctcatttcctttccatcatggaaatctatcctcaaggaaataacttctcagtgttccatctgctattctactgctccgcagggattattcagggcccctcccttccctacacatcaagctcaaggatttgcccccacccaggactggcaaattagctttactcaacatgccccgagacataactaaaatacctcttagtctaggtagacactttcactggataagtagaggcctttcctacagggtctgagaaggctaccgcagtcatttcttcccttctgtcagacataattcctcagtttaaccttcccacctctatacagtctgataacagaccagcctttattagtcaaatcagccaagcattttttcaggctcttagtattcagtgaaacctttatgtcaattacagtcccaagtcttcaggaaaagtagaacagactaatagtcttaaaaacacacctcaccaagctcagccaccaacttaaaaaagactggacaatacttttaccactttcccttctcagaagtcagagctgtcctcagaatgctacaagggacagcccatttaagctcctgtatagatgctcctttttattaggtcccagtctcattccagacaccagagcaacttagactgtgcccccaaaaaacttgtcatccctactatcttctgtctagtcatactcctattcaccattctcaactactcacacatgccctgcttttgtttacactgccagtttacactgtttctctaagccatcacagctgatatctcctggtgctatccccaaactgccactctaaactcttgaagtaaataaataatctttgctggcaggactatgctgaatctccttaggcactctctaatcaggtgtcctgggtcctcccaattcttaggccttttatacctgtttttctccttctcttattccatttagtttttcaattcatacaaaaccatatccaggccatcaccaataattctacacgacaaatatttcttctaacaaccccacaatatcaccccttaccacaaaatcttccttcagcttaatctctcccactctaggttcccacgccgcccctaatcccgctcgaagcagccctgagaaatatcgcccattatctctccacaccaccccccaaaattttcaccatcccaacactttaccactatttcattttatttttcttattaatataagaagacaggaatgtcaggcctctgagcccaagctaaaccatcatatccctgtgacctgcacgtacacatccagatggcccgtttctgccttaactgatgacattccaccacaaaagaagtgaaaatggcctgttcctgccttaactgatgacattttcttgtgaaattcctggctcatcctggctcaaaagctcccctactgagcaccttgtgaccccccactctgccctccagagaacaaccccccttgactgtaattttcctttatctacccaaatcctataaaatggccccacccttatctcccttcgctgactctttttggactcagcccacctgcacccaggtgattaaaagctttattgctcacacaaagcctttttggtggtctcttaatacggacgacgcgcatgaaa

SEQ ID NO: 102 - DNA, 202 bp, Homo sapiens; identical to SEQ ID NO: 89

SEQ ID NO: 103 - DNA, 5594 bp, Homo sapiens
caggattccacggatggcccaaatgcattcaatctgtagcagcaactgctttgttaacagaagaaagtagaaaagtaatttttgaggaaacctcattgtgagcacacctcaccagtttagaattattctaagtcaaaaaagcaaaaaggtagcttactaactcaaaaatcttaaagtatggggctattttgttagaaaaaggtgatttaacattaaccactgaaaattcccttaacccagcagattttctaacaggggatttaaatcttcattaccatacaaaggtccaaccagacctagtaggaactcccttcagaacaggatgatagatggttcctcccgggtgattgagggaaaaaaaaccacaacgggtattcagtaattgatagggagactcttgtggaagcagagttaggaaaattgcctaataattggtctgctcaaacaagagctgtttgcactcagccaaaccttaaagtacttacagaatcgaaaagagtctatctcaatcttgactcaaaatgttacctacaccctctctgaagtgaatttgcataagaactattgtttatgggaatgcatcttgatggggcagctaggttgttatgaaatactcaggaactcagcccagctctagaactcacctctgagcgcaaaggcaatgttgtgcacactggtaaaggaccactagaatccagcagcccggacccctttatctgtggtcaagaaaggtgggaaaacaggtgcacgactgctacattggtgagcataactaatccgataagcagaggtccatggatggttacgcaccctggaaaggaataagcattaggaccatagaggacactctatgactaatgctcattggaaaatgactaggggtgctggcatctctctgtctttttccagatgggaaacgtttccctcaaggcaaaaatgccccctaagatgtattctggagaattcggcccagtcagagtgtatgtatcttttcccctgtcagacttgaagcaaattaaaatagacctaggtaaattctcagataaccgtgatggctatattgatgttttacaagggttaggacaatcctttgatctgacatggagagatataatgttactgctaaatcagacactaaccccaaataagagaagtgccacaataactgcagcccgagagtttggcgatctctggtatctcagtcgggtcaatgataggatgaaaatagaggaaagagaacaattccccacaggccagcaggcagttcccagtgtagaccctcactgggacgcagaatcagaacatggatattagtgccacagacatttactaacttgcgtgccagaaggactaaggaaaactagggagcagcctataaatttttcagtgatgtctactataacacagggaaaggaagaaaatcctactgcctttctggagagactaagggaggcattgaggaagcatacctctctgtcacctgactctattgaaggccaactaatcttaaaagataagtttatcactcagccagctgcagacatcagaaaaaaaacttcaaaagtctgctttaggcccggagcaaaacttagaaaccctactgaacttggcaacctcggttttttataatagagatcaggaggagcaggcagaacaggacagatgagataagaaaaaggccaccgctttagtcatggccctccaagctgactttggaggctctggaacgtggaaagcctgggcaaatcgaatgcctaatagggcttgcttccagtgcagtctacaaggacactttaaagaagattgtcgaatagaaatgagctgcccccttgtccatgccccttatctcaagggaatcattggaaggcccactgccccaaggaatgaaggtcgtttgaatcagaagccactaacctgatgatccagcagcaggactgagggtgcccggggcaagtgcctgcccataccatcaccctcacagagctccaggtatgcttgaccattgagggccaggaggttaactgtctcctggacactggcatggccttctcaatcttactttcctgtcctatacaactgtcctccagatctgtcactagccaaggggtcctaggacagccagtcactagatacttctcccagccactaaggtgtgactggggaactttactcttttcacatgcttttctaattatgcctgaaagcaccactctcttgttacggagagacattctagcaaaagcaggggccattgtacacctgaacataggagaaggaacacccgtttgttgtcccctgcttgaggaaggaattaatcctgaagtctggacaacagaaggacaatatggatgagtaaagaatgcctgtcctgttcaagttaaactaaaggattccacctcctttccctaccaaaggcagtaccctcttagacccgaggcccaacaaggactccaaaagattgttaaggacctaaaagcccaaggcctactaaaaccgtgcaacagcccctgcaatactccaattttaggagtacagaaacccaacagacagtggagtttagtgcaagatctcaggattatcagtgaggccgttgtctctctatacccactgtacctaacccttatactctgctttcccaaataccagaggaagcagagtggtttacagtcttggaccttaaggatgcctttttctgcatccctgtacatcctgactctcaattcttgtttgcttttgaagatccttcgaacccaacatctcaactcacctggactgttttaccccaagggttcaaggatagcccccatctatttggccaggcattagcccaagacttgagccagttttcatacctgaacactctcatcttttggtacatggatgatttacttttagccacccgttcagaaaccttgtgccatcaagccacccaagcactcttaaatttccttgccacctgtggctacaaggcttccaaacaaaaggctcagctctgctcacagcagaaatacttagggctaaaattatccaaaggcaccagggccctcagtgaggaatgtatccagcctatactggcttatcctcatcccaaaaccctaaagcaactaagagggttccttggcataacagccttttgctgaatatggattcccaggtacggcgaaatagccaggccattatatgcactcattaaggaaactcagaaagccaatatccatttagtaagatgtacacctgaagcagaagcagctttccaggccctaaagaaggccctaacccaagccccagtgttaagcttgccaacagggcaagacttttctttatatgtcacagaaaaaaacaggaatagctctaggagtctttacacaggtccaagggaacagcttgcaacctgtggcatacctgagtaaggaaattgatttagtggcaaagggttggcctcattgtttacaggtagtggcagcagtagcagtcttagtatctgaagcaggtaaaataatacagggaagagatatgactgtgtggacatctaatgatgtaaacagcatactcactgctaaagaagacttgtggctgtcagacaactgtttgcttaaatatcaggctgtattacttgaagggccagtgctgagaacttctctcttgtgcaactcttaacccagccacacttcttccagacaatgaagaaaagatagaacataactgtcaacaggtgattgctcaaacatacgccactcaaggggaccttctagaggttcccttgactgatcccgacctcaacttgtatactgatggaaattcctttgtagaaaaaggactttgaaaagtggggtatgcagtggtcagtgataatggaatacttgaaagtaatcccctcactccaggaactagcgctcggctggcagaactaatagccctcactggggcaccagaattagaaggaaaaaggggaaatatgtatacagactctaatatgcttacctactcctccatgcccacacagcaatatggagagaaagggaattcctaacttctgagggaacacctatcaaacatcaggaagccattaggagattattattcactgtacagaaacctaaagatgtggcagtcttacactgccggggtcatcagaaaggaaagtaaagggaaatggaagagaaccaccaagcggatattgaagcccatcaacagccacaaggcaggaccctccattagaaatgcttatagaaggaccctagtatggggtaatcccctctgggaaactaagctccagtactcagcaggagaaatagaatggggaacctcacaaggacatagtttcctcccctcaggatggctagccaccgaagaaggaataacacttttgccggcagcgaaccaatggaaattgcttaaaacccttcaccagacctttcacttaggcattgatagcacccaccagatggccaaattattatttactggaccaggccttttcaaaactatcaagcagatagtcagggcctgtgaagtgtgccaaagaaataaccccctgcactgccggccatacatttcaatccctgtatctttaacctccctgttaagtttgtttcttccagaatcgaagctgtaaaactacaaatcattcttcaaatggaaccccagatgcagtccatgactaagatctactgcggacccctggaccggcttgctagcccatgctccaatgttgatgacattgaaggcccccctcctgaggaaatctcaactgcacgatccctactatgccccaattcagcaggaagcagagcagtcgtcggccaacctccccaacagcactggggttttcctgttgagaggggggactgagagacaggactagctggatttcctaggccgactaagaatccctaagcctagctgggagggtgccgcatccacctttaaacacggggcctgcaacttagctcacacccaaccaatcaggtagcaaagagcgctcactaaaatgctaattaggcaaaacaggaggtaaagaaatagccaatcatctatcacctgagagacaatgattgggatataaacccaggcatttgagccagcaatggcaaccccctttgggtccccttccattgtgtgggagctctgttttcactctattacatcttgcaactgaacattcttctggtccgtgtttgtaacagcttgagctgagctttctctcactgtccaccactgctgtttgtcgccattgcagacccgccactgacttccgcccctctggatccggcagggtgttggctgcactcctgatccagtgactcacccattgctgctcctgatcgggctaaaggcttgccattgttcctgcatggctgagtgcctgggttcttcctaatctagctgaacactagtcgctgggttctatggttctcttttgtgacccacagcttctaataaagctataacactctctgcatggcccaagattccattccttggaatccatgaggccaagaaccccaggttagagaacaagaggctggctgccatcttggaagcggcctgccaccatcttgggagctctaagaacaaggacccccaggtaacat

SEQ ID NO: 104 - DNA, 958 bp, Homo sapiens
gtggggaaaagaaagagagatcagattgttactgggtctgtgtagaaagaagtagacataggagactccattttgttctgtactaagagaaattcttctgccttcagatgctgttaatctgtaaccttacccccaaccctgtgctccctgaaacatgtgctgtgtccactcagggttaaatggattaagggctgtgcaaggtgtgctttgttaaacagatgcttgaaggcagcatgcttgttaagagtcatcaccactccctaatctcaggtacccagggacacaaaacactgcggaaggccgcagggacctctgcctaggaaagccaggtattgtccaaggtttctccccatgtgatagtctgaaatatggccttgtgggaagggaaagacctgaccgtcccccagcccgacacccataaagggtctgtgctgaggcggattagtaaaagaggaaggaacgcttctttgcagttgagacaagaggaaggcatctgtccctgggcgatggaatgtctcagtataaaacccgattgtatgttccatctactgagatagggaaaaaccgccttagggctggaggtgggacaggcgggcagcaatactgctcttcaaggcattgagatgtttatgtgtatgcatatctaaagcacagcacttaattctttaccttgtctatgatgcagagaactttgttcacgtgtttacctgctgaccttctctccgctattatcctatgaccctgccacatccccctctctgagaaacacccaagaatgatgaataaatactaagggaactcagaggccggcggggatcctctgtctgctgaacgccggtcccctgggcccccttttctctttctctatactttgtctctgtgtctctttcttttccaagtctctcgttccacctaacgagaaacacccacaggtgtggaggggcaacccaccccttca

SEQ ID NO: 105 - DNA, 9096 bp, Homo sapiens
gtcaggcctctgagcccaagccaagccatcgcatcccctgtgacctgcacgtatatgcccagatggtctgaagtaactgaagaatcacaaaagaagtgaatatgccctgccccaccttaactgatgacattccaccacagaagtgtaaatggccagtccttgccttaactgatgacattaccttgtgaaagtccttttcctggctcatcctggctcaaaaagcacccccactgagcaccttgcgacccccactcctgcccaccagagaacaaaccccctttgactgtaattttcctttacctacccaaatcctataaaatggccccacccttatctcccttcgctgactctcttttcggaatcagcccacctgcactcaggtgattaaaagctttattgctcacacaaagcctgtttggtggtctcttcacacggacatgcatgaaatttggtgccatgattcggatcaggggacctcccttgggagatcaatcccctgtcctctgttctttgctccatgagaaagattcacctatgacctcaggtcctcagaccgaccagcccaagaaacatctcaccaatttcaaatccggtaagcggcctctttttactctcttctccaacctccctcactatccctcaacctctttctccttccaatcttggcgccacacttcaatctctcccttctcttaatttcaattcctttcattttctggtagagacaaaggagacacgttttatccatggacccaaaactccggcaccggtcacggactgggaaggcagccttcccttggtgtttaatcattgcagggatgcctctctgattatacactcacgtttcaagggtgtcagaccacacagggacacctgccttggtccttcacccttagcggcaagtcccgcttttctggggaagggacaagtacccctcaaccccttctctccttgtctctaccccttctctgcttttctggggcaggggcaagaacccctcaaccccttctccttcacccttagcggcaagtcccacttttctagggggcaagaacccccaatcccttatttctgtgccccaatctcttatctcttatctctgtgccccaatcccttatttctgcaccccaacctcttatctgtgccccaatcccttatttctgcagcccaacctcttatctctgtgccccaatcccttatttccatgccctgaccccccttcctgcttttctggagggtaagaacctccgaaccccttccctccgtgtctctatgctctcttttctcttggtttgcctcctttactatgggcaaccttccaccctccattcctccttctcctttagcctgtgtcctcaagaacttaaaacctcttcaactcacacctgacctaaaacctaaatgccttattttcttctgcaacactgcttggccccaatacaaatcgacagtggctctaaatggccagaaaacggcactttcgatttcttcatcctacaagacctaaataatttttgtcgaaaaatgggcaaatggtctgaggtgccttacgtccaggcatttttcacacttcgttccctccctagcctctgttcccaatgcgattcctcccagatcctccttctttccctcccgcctgtcccctcagtcccaaccccaagcatcgctgagtctttccagtcttccttttctacagacccatctgacctttcccctcctccccaggctgctcattgccaggccgagctaagtcccaattcttcctcagcctccactcctccaccctataatccttctatcacctcccctcctcacacccggtccggcttacagtttagttccgcgactagctcttccccacctgcccaacaatttcctcttagagaggtggctggagctgaaggcatagtcagggtacatgtacctttttctctatcagacctttctcagatcagtcaatgtttaggctctttctcatcagaccccactaaatatacacaggaattccaatgtctaactctgtcctacaacttaacctggagtgacttaaatgtcatcctgacttctaccctctccccagatgaatgggaaagagtttcttctctagcccaatctcatgctgataaccgccggcttcacgagccagacctccaggaaggcattagagcagttccccgagaggatccccaatggaaccatcaggcaaattccccaggtatagctaggcgagattacatggtttcctgcctagttgaagggcttaaaaaagcagcttacaaagctgttaattatgacaaacttaaagaaactacccaaggtgaagatgaaaacccagcccaggtcgtggcccgcttagcagcaacccttagacgctttaccgccctagacccagaggggccagaaggccgccttattctcaatatgcattttatcacccagtcagctcctgacattacaaaaaaacttcaaaaattagaatctggccctcaaaccccacaacaggaattaatcaacctcaccttcaaggtgcacaataatagggaggaagcagccagacggcaatgcatttctgagttacagttacttgcccctactgtgagacaaaacccagccacacctcctgcataggagaacttcagaatgcctaagccacagcagtcaagcattcctacaagacttcctccatcaggatcttgcttcaagtgccagaaatctggccactgggccaaggaatgcccgcagcccgggattcctcccaagccatgtcccatctgtgcagggactcactgcaaatcagactgcccagctcacccggcagccactcctagaacccctaaagctctagcccaaggctctctgactgactccttcccagatctgcttggcttagcaactgaagattgacattgcccgatcgcctcggaagccccctggaccatcatggacgccgagctttgggtaactctcacagtggagggtaagtccatcccctgtttaatcgatacgggggctacccactccacattgccttcttttcaagggcctgttttccttgcccccataactgttgtgagtattgacggccaagcttcaaaacccctgaaaactcccccactctggtgccaacttggacaacactcttttatgcactcttttttagttatccccacctgcccagttcccttattaggccaagatattttaaccaaattatctgcttccctgactgttcctggactacagccacatctcattgccgcccttctccccaaccaaaagcctccttcgcatcttcctctcatatccccccaccttagcccacaagtatgggacatctctactccttccctggcaaccgatcacatgcccattaccatcccattaaaacctaatcacccttaccctgctcaacaccaatattccatcccacagcatgctttaaaatgattaaagcctgttatcactcacctgctacagcatgggcttctaaaacctataaactctccttacaattcccccattttacctgtccaaaaaccggataagtcttacagattagttcaggatctgcgtcttatcaaccaaattgttttgcctatccaccctgtggtgcccaacccgtacactcttttgtcctcaataccttcctccacaactcactattccatgcttgatcttaaagatgcttttttcactattcccctgcacccctcgtcccagcctctctttgctttcacctggactgaccctgacacccatcagtcccagcagcttacctgggctgtgctgccgcagggtttcagggacagccctcattacttcagccaagctctttctcatgatctactttccttccacccctccgcttctcaccttattcaatatattgatgaccttcttctttgtagcccctcctttgaatcttctcaacaagacacacttctgctccttcagtgtttattctccaaaggatatcgggtatccccctccaaagctcaaatttcttctccatccgttacctacctcggcataattcttcataagaacacacatgctctccctgccgatcgtatccgactaatctctcaaaccccaatcccttctacaaaacaacaactcctttccttcctcggcatggttggatactttcacctttggatacctggttttgccaacctaacaaaacaattatataaactcacaaaaggaaacctagctgaccccatagatcctaaatcctttccccactcctctttccattccttgaagacagctttagagactgcccctattctagctctccctgactcatcccaacccttttcattacacacagccgaagtgcagggctgtgcagtctgaattcttacacaaggaccaggatcgcatcctgtagcctttttgtccaaacaacttgaccttactgttttaggctggccatcatgtctccgtgcagccgctgctgctgccctaatacttgtagaggccctcaaaatcacaaactatgctcaactcactctctacagctctcataatttccaaaatctattttcttcctcacacctgacacatatactttctgctccccggctccttctgctatactcactctttgttgagtctcccacaattaccattgttcctggcctggacttaaatgcggcctcccacattattccggataccacacctgaccctcatgactgcatctctctgatccacctgacattcacatttccccaaatttccttcttccctgtttctcaccctgatcacacttggtttattgatggcagttccaccaggcctaatcaccactcaccagcaaaggcaggctatgctatagtatcttccacatctatcattgaggctaccgctctgcctccctccactacctctcagcaagccgaactagttaccttaactcaagccctcactcttgcaaaaggactacgcatcaatatctatactgattctaaatatgcctttcatattctgcagcaccatgcagtcatatgggctgaaagaggtttcctcactacacaagggtcctccatcattaatgcctctttaataaaaactctgctcaagaccactttacttccaaaagaagctggggtcattcactgcaaggggcatcaaaaggcatcagatcccattgctctaggcaatgcttatgctgataaagtggctagacaagcagctagctctccaacttctgtccctcacagccagtttttctccttcgcttcagtcactcccacctactcccccacggaaacttccacctatcaatctcttcccacacaaggcaaatggttcttagaccaaggaaaatatcttcttccagcctcacaggcccattctattctgtcatcatttcataacctcttccatgtaggttacaagccgctagaccgtctcttagaacctctcatttcctttccatcatggaaatctatcctcaaggagatcacttctcagtgttccatctgctattctactacccctcagggattgttcaggccccctcccttccctacacatcaagctcggggatttgcccctgcccaggactggcaaattgactttactcacatgcctcgagtcagaaaactaaaatatcttagtctgggtagacactttcactggatgggtagaggccttccccacagggtctgaaaggccaccgcggtcatttcttcccttctgtcagacataattcctcggtttggccttcccacctctatacagtctgataacggaccagcctttactagccaaatcacccaagcagtttctcaggctcttggtattcagtggaaacttcatatcccttaccatcctcaatcttcaggaaaggtagaacggactaatggtcttttaaagccacacctcaccaagctcagcctccaacttaaaaaagattggacagtacttttacctcttgctcttctcagaatcagagcctgtcctcgagatgctacagggtacagtccatttgaacttttatatggacgcactttcttgcttggccccagcctcatcccagacaccagccctctaggtgactatcttccagtcctccagcaggctagacaggaaattcaccaggcttctaatcttctcttacctactccagatcgccagccatatgaagacaacctagctggacgatcagttgttgttaagaatctgacccctcaaactctacaacctcgatggacgggaccctacttagtcatctatagtccccgactgccgtccgcctgcaggatcctccccactgggttcaccattccagaataaagctgtgtccatcggacagccagcctaatccctcctcttcctcctagaagtcacaagtactctcccccacttaagtactctcccccacttcccttaaactcactcgtatttctgaagaacagtaataacccttatgagcctaatacatcccttcattctattaggtctgttcgtccttaccctactttttgcaacagggctttacgaagtcacccccaccacttaggccgagccccaaaaactagtcatccctactatcttctgtccggtcatactcctattctccattctcaactacttataaatgccctactcttgtttacactgccagtttacactgtttcttcaagccattacagctgatatctcttggtgctatccccaaaccaccactcttaactccctcttagagtggatagatgatctttgctggcagggcaccctccaatacttccaaccctgatgaagttctactctttacttttatgctcactcttattctcattcccattcttatgtcaccctctacctctccccagctatctccaccacagtatcaaccttacccattctctcctagccgcttctaatccctccttggcgaacaactgctgcctttgcatttccctttcttccagtgcctacacagctgtccccaccttacagacagactgggcaacaccccccgtctccctacacctccgaacttcctttaacagccctcaactttaccctcctgaagaactcatttactttctggacaggtccagcaagacttccccagacatttcacatcagcaagctgccgccctccttcgcacttatttaaaaaacctttctccttatattaactctacttcccccctatttggacctctcacaacacaaattactattccagtggccactcctttatgtatctctccgcaaagacccactggaattcccctaggtaatcttttaccttctcgatgttcctttactcttcatctccgaagcccaactacacacatcactgaaacaactggagccttccagctgcatattacagacaagccctctatcaatacaggcaaacttaaaaaaattcgcagcaattattgcttaggaagacacttgccctgtatttcactccatccttggctaccttccccttgctcgtcagactctcctcccaggccctcttctcgtttacttatacccagccccgaaaataacagtgaaaggttgctcatagatactcaatgttttctcatacaccatgaaaatcaaaactccccctctatgcagttaccccatcagtccccattacaacctctgacagctgccgccctagctggatccctaggagtctgggtacaagacacccctttcagcactccttctcatctttttactttacatctccagttttgcctcacacaaggtctcttcttcctctgtggatcctctacctacatgtgtctacctgctaattggacaggcacatgtacactagtcttccttacccccaaaattcaatttgcaaataggaccgaagagctccctgttcccctcatgacaccaacatgacaaaaaagagttcttccactaattcccttgatggtccgtttaggactttctgcctccactattgctcttggtactggaatagcaggcatttcaacctctgtcacgaccttctgtagcctgtgtaatgacttctctgctagcatcacagacatatcacaaactttatcagtcctccaggcccaagttgactctttagctgcagttgtcctccaaaactgccgaggccttgacttactcactgctgaaaaaggaggaccctgcatattcttaaatgaagagtgttgtttttacctaaatcaatctggcctggtgtatgacaacataaaaaaactcaaggatagagcccaaaaacttgccaaccaagcaagtaattacgctgaacccccttgggcactctctaattggatgtcttgggtcctcccaattcttagtcctttaatacccatttttctccttcctttatttgaaccttgtatcttctgtttagtttctcaattgatccaaaaccgtatccaggccatcaccaatctttctatacgacaaatgtttcttctaacatccccacaatatcaccccttaccacaagacctcccttcagcttaatctctcccactctaggttcccacgcccccccaatcccgcttgaagcagccctgagaaacatcgcccattctctctccataccaccccccaaaaatttttgccgccccaacacttcaacactattttgttttatttttcttattaatataagaaggcaggaatgtcaggcctctgagcccaagccaagccatcgcatcccctgtgacctgcacgtatatgcccagatggtctgaagtaactgaagaatcacaaaagaagtgaatatgccctgccccaccttaactgatgacattccaccacaaaggaagtgtaaatggccggtccttgccttaactgttgacatcactttgtgaaagtccttttcctggctcatcctggctcaaaaagcacccccactgagcaccttgcgacccccattcctgtccaccagagaacaaaccccctttgactttaattttcctttacctaccgaaatcctataaaatggccccacacttatctccctttgctgactctcttttcggactcagcccaactgcacccaggtgatcaaaagctttattgctcacacaaagcctgtttggtggtctcttcacatagacacgcacgaaa

SEQ ID NO: 106 - DNA, 440 bp, Homo sapiens
gtcaggcctctgagcccaggccaggccatcgcatcccctgtgacttgcacgtatacatccagatggcctaaagtaactgaagatccacaaaagaagtaaaaacagccttaactgatgacattccaccattgtgatttgttcctgccccaccctaactgatcaatgtactttgttttctcccccacccttaagaaggttctttgtaattgtccccacccttgagaatgtactttgtgagatccacccctgcccaccagagaacaaacccctttgactgtaattttccattaccttcccaaatgctataaaacggccccacccctatctccctttgctgactctcttgtcggactcagcccacctgcacccaggtgaaatagacagccatgttgctcacacaaagcctgtttggtggtctcttcacacggacgtgcatgaga

SEQ ID NO: 107 - DNA, 1000 bp, Homo sapiens
gtggggaaaagaaagagagatcagactgttactgtgtctatgtagaaagaagtagacataagagactccattttgttctgtactaagaaaaattcttctgccttgagatgctgttaatctgtaaccctggccccaaccctgtgctcacagagacatgtgctgtgttgactcaaggtttaatggatttagggctatgcaggatgtgctttgttaaaaaagtgttgaaggcagtatgcttgttaaaagtcatcactattctctaatctcaagtacccagggacacaatacactgcagaaggctgcagggatctctgtctaggaaagccaggtattgtccaaggtttctccccatgtgatagcctgagatatggcctcgtgggaagggaaagacctgggaagggaaagacctgaccgtcacccagcccgacacccgtaaagggtctgtgctgaggaggattagtgaaagaggaaggcctctttgcagttaaaataagaggaaggcatctgtctcctgctcgtccctgggcaatgatgtctcggcgtaaaaccgactgtatgttctatttactgagataggagaaaactgccttagggctggaggtgagccgtgctagcagcaatattgctctttaatgcaccaaggtgtttctatacatgcacatcaaggcacagcacctttccttaaacttatttatgacacagagatctttgttcacatgtttcctgctgaccctctccccactattgccctattgtcctgccacatcctcctctccgagatggtagagataatgatcaataaatactgagggaactcagagaccagtgcctgccggtcctccgtaaactgtaagctgagtgcctccgtaagctgagcgccagtcccctaggcccacttttctttctctattctttgtctctgtgtctctttctcttctcagtctctcatcctacctgatgagaaacacccacaggtgtggaggggcaggccatcccttca

SEQ ID NO: 108 - DNA, 5899 bp, Homo sapiens
gtcaggcctctgagcccaagccaagccatcgcatcccctgtgacttgcacgtatacatccagatggcctgaagtaactgaagatccacaaaagaagtaaaaatagccttaacagatgacattccaccattgtgatttgttcctgccccaccctaactgatcaatgtactttgtaatctcccccacccttaagaaggttctttgtaattctccccacccttgacaatgtactttgtgagatccaccctgcccacaaaacattgctcttaacttcactgcctatcccaaaacctataagaactaatgataatccaccaccctttgctgactctcttttcggactcagcccgcctgcacccaggtgaaataaacagccatgttgttcacacaaagcctgtttggtggtctcttcacacggatgcacatgaaatttggtgccgtgactcggatcgggggacctcccttgggagatcaataccccgtcctcctgctctttgctccgtgagaaagatccacctacgacctcaggtcctaagaccgaccagcccaagaaacatctcaccaatttcaaatccagtaagcggcctctttttactctcttctccaacttccctcactatccctcaacctctttcttctttcaatcttggcgctacacttcaatctctcccttctcttaatttcaattcctttaattttctggtagagacaaaagagacatgttttatccgtggacccaaaactccagcgcctgtcatggactgggaaggcagccttccctttgtgtttaatcattgcagggatgcctctctgattatacacccatgtttcaagggtgtcagaccacgcagggacacttgccttggtccttcacccttagcggcaagtcccgcttttcttgggaaggggcaagtaccccaatcccttctctccttgtctctaccccttctctgcttctctggggaaggggcaagtaccccaaccccttctctccttgtctctaccccttctctgcttttctggggaaggggcaagtacccctcaacccccttctccttcacccttagcggcaagtcccgctttcctagagggcaagaacccccccaatcgcttatttctgcaccccaacctcttatctctgtgctccaatcccttatttccacaccctgaccttttatctctgtgccccaatcccttatttccatgccccaaccccttctctgcttttctggagggcaagaaccccccaccccttctccgtgtctctactcttttctctgggcttgcctccttcactatgggtaagcttccaccttccattcctccttcttctcccctagcctgtgttctcaaaaacttaaaacctcttcaactcacacctgacctaaaacctaaatgccttattttcttctgcaatgccgcttgaccccaatacaaactcaacagtagttccaaatagccagaaaatggcactttgaatttttccatcctgcaagatctaaataattcttgttgtaaaataggaaaacggtctgaggtgcctgacatccaggcattcttttacacatcagtcccttcctagtctctgtgcccagtgcaactcatcccaaatctttcttctttccctcctgcctgtcccctcagtcccaaccccaagcgtcactgagtctttctaatcttccttttctacagacccatctgacctctcccctcctcgccaggccgagctaggtcccaattcttcctcagcctccgctcctccaccctataatctttttatcacctcccctcctcacacctggtccggcttgcagttttgttccatgactagccctcccccacctgcccagcaatttaatcttaaaaagccaaaggcatagtcaaggttaatgctcctttttctttatcccaaatcagatagcgtttaggctctttttcatcaaatataaaaatccagctcagttcatgacttgtttggcagcaaccctgagatgctttacagccctagaccctaaaaggtcaaaaggccatcttattctcaatatacattgtattacccaatctgctcccgacattaaataaaactccaaaaattaaattccagccctcaaaccccacaacaggatttaattaacctcaccttcaaggtgtacaataatagaaaaaagttgcaattccttgcctccactgtgagacaaaccccagccacatctccagcacacaagaacttccaaacgcctgaactgcagtggccaggcgttcctccagaacctcctcccacaggagcttgctacacgtgccggaaatccggccactgggccaaggaatgcccgcagcccaggattcctcctaagccgcgtcccatctgtgtgggaccccactgaaaatcagactgttcaactcacctggcagccactcccagagcccctggaactctggcccaaggctctctgactgactccttctcagatcttctcggcttagtggctgaagactgacactgcccgatcgcctcggaagccccctaaaccatcacggatgccgagcttccggtaactctcacagtggaaggtaagcccgtccccttcttaatcaatacggaggctacccactccacattaccttcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggctgagacactaactaaattatctacttccctgactattcctggactacagctatatctcattgccacccttcttcccaatccaaagcctcctttgcatcctcctcttgtatccccccaccttaacccacaaatatgagatacctctactccctccttggcgactgatcatgcaccccttaccatctcattaaaacctaatcacccttaccccactcaacgccaatatcccatcccacagcatgctttaaaaagattaaagcctgttatcactcgcttgctacagcatggccttttaaagcctataaactttccttacaattcccccattttacctgtcctaaaaccagacaagccttacaagttagttcaggatctgctccttatcaaccaaattgttttgcctatccaccccatggtgccaaacccatatactctcctatcctcaatacctgcctctacaacccattattctgttctagatctcaaacatgctttctttaccattcctttgcacccttaatcccagcctctcttcactttcacttggactgaccctgacacccatcaagctcagcaaattacctaggctgtacggctgcaaagcttcacagacagcccccattacttcaatcaagcccaaatttcttcctcatctgttacctatcttggcataattctcataaaaacacacgtgctctccctgccaatcgtgtctgactgatctctcaaaccccagcaccttctacaaaacaacaactcctttccttcctaggcatggttagtgcagtcagaattcttacacaagagccaggaccgcaccctgtagcctttctgtccaaacaacttgaccttactgttttagcctagccctcatgtctgcgtgcagtggctgccgctgcattaatacttttagaggccctcaaaatcacaaactatgctcaactcactctctacagttctcataacttccaaaatctattttcttcctcatacctgacgcatatactttctgcttcccagctccttcagctgtactcactctttgttaagtcccacaattaccattgttcctggcccagacttcaatctggcctcccacattattcctgataccacacctgacccccatgactgtatctctctgatccacctgatattcaccccatttccccatatttccttctttcctgttcctcaccctgatcacgcttgatttattgatggcagttccaccaggcctaatcgccacacaccagcaaaggcaggctatgctatagtacaagccactagcccgcctctcagaacctctcatttcctttccatcgtggaaatctatcctcaaggaaataacttctcagtgttccatctgctattctactacccctcagggattgttcaggcctcctccctttcctacacatcaagctcgaggatttgcccctgcccaggactggcaaattgactttactcatatgcctcgagtcagaaaactaaaatatctgttagtctgggtagacaccttgactggatgggtagaggccttccccacagggtctgagaaggccaccacagtcatttcttcccttctgtcggacataattcctcggtttggccttcccacctctatacagtctgataacggaccagcgtttactagccaaattacccaagcagtttctcaggctcttggtattcagtggaaccttcatatcccttaccatcctcaatcttcaggaaaggtggaacggactaatggtcttttaaaggcacacctcaccaagctcagcctccaacttaaaaaggattggacagtacttctacctcttgctcttctcagaatcagagcctgtcctccagatgctacagggtacagtccatttgaacttttatagggatgcactttcttgcttggccctaacctcatccagacaccagccctctaggcgactatcttccagtcctccagcaggctagacagcaaattcgccaggctgctaatcttctcttgcctactccagatccccagccatatgaagacaccctagctggatgatcagttcttgttaagaatctgacccctcaaactctacaacctcgatggaccggaccctacttagtcatctatagtaccccgactgccatccgcctgcaggatcctccccactggtttcaccattccagaataaagctgtgtccattggacagctagcctaatccctcctcttcctcctggaagtcgcaagtactttcccctacttcccttaaactcactcgtatttctgaagaacagtaataacacttatgagcctaatacatcccttcattctattagatcttttcgtccttaccctactttttgcaacagggctttacgaagccacccccaccacttagactgtgccccaaaaaaacttgtcatccctactatcttttttctagtcatactcctattcaccgttctcaactactcatacatgccctgctcttgtttacactgccggtttacactgtttctccaagccatcacagctgatatctcctggtgctatacccaaactgccactctaaactcttgaagtaaataaataatctttgctggcaggactatgctgaatctccttaggtactctctaatcagatgtcctaggtcctcccaattcttagaccttttatacctgtttttctccttctcttattccatttagtttctcaattcatccaaaaccgtatccaggccatcgccaatcattctatacaacaaatgtttcttcttacatccccacaatatcaccccttaccacaagacctcccttcagcttaatctctcccattctaggtttccacgccaccccaatcccgcctgaagcagccctgagaaacatctcccattctctctccataccaccccccaaaaatgttcaccgccccaacacttcaacactattttgttttatttttcttattaatataagaaggcaggaatgtcacgcctctgagcccaagccaagccatcgcatcccctgtgtgacttgcacgtatacatccagatggcctgaagtaactgaagatccacaaaagaagtaaaaatagccttaactgatgacattccaccat

SEQ ID NO: 109 - DNA, 6860 bp, Homo sapiens
caggcctctgagcccaagctaagccatcatatcccctgtgacctgcacgtatacatccagatggcctgaagcaactgaagatccacaaaagaagtgaaaatagccttaactgatgacattccaccattgtaatttgtttctgccccaccctaactgatcaatgtactttgtaatcgccccaacccttaagaaggttctttgcaattctccctatccttgagaatgtacttcgtgagatccaccccctgcctgcaaaaaattgctcctaactccaccgcctatcccaaaacctataagaactaatgataatccaccaccctttgctgactctctttttggactcagcccacctgcacccaggtaatataaacagccttgttgctcacacaaagcctgtttggtggtctcttcacacggacatatgagacatttggtgccaaagaccccggtcagcgggactccttcaggagaccagtcccctgttcttgccctcactccatgaagagatccacctacgacctcgggtcctcagaccaaccagcccaaggaacatctcaccgattttaaatcgggtaagtggcctctttttactctcttctccaatctctctcactatccctcaacctctttctcctttaaatcttggtgccacccttcaatctgtcccttctcataatttcaattcctttcattttctggtagagacaaaggagacacattttatccgtggacccaaaactccggcgcaggtcacagactcgggaaggcagccttcccttagtgtttaatcattgcaggtcgcctgcctgattattcacccacgtttcagaggtgtctgacctcacggggacacctgccttggtccttcacccttagcggcaagcaccacttttctggggggcaagcaccccttgacaccttctctccatgtctccaccccttctccactttcctggggggcaagcactccccaccccttctctccgtgtctctactctctcttttctctccacttttctgggggacaagcaccccccaccccttctctccatttctctactctctcttttctctccactttcctgggaggcaagcaccccccactccttctctccatgcctctactctctcttttctctccacttttctggggaacaagcaccccccaccccttctctccgtgcctctactgtcttttctctccacttttctggggggcaagcagcccccacctcttctgtctgtgtctctatcccttctccactttcctggggggcaagcacctcccaccccgttcccactttcctgggggacaagcacctcccaccccattcccactttcctggggggcaagcacctcccaccccgttcccactttcctggggggcaagcacctcccaccccattcccactttcctgggggacaagcacctcccaacccgttcctactttcctggggggcaagcacctcccaccccgttcccactttcctgggggacaagcacctcccaacccgttcctactttcctggggggcaagcacctcccaccccgttcccactttcctggggacaagcacctcccaccctgttcccactttcctggggggcaagcacctcccacctcattcccactttcctgggagataagcacctcccaccccgtttcaactttcctggggggcaagcacctcccaccccttctccactttcctggggggcaagcaccccctaccccttctctccatgtctctacccttctctttaaacttgcctccttcactatgggcaaccttctaccctccattcctccttctcccttagcctgtgtcctcaagaacttaaaacctcttcaactctcgcctgacctaaaacttaaacgccttattttcttctgcaatactgcttgaccccaatacaagctcgacaatggttctaaatggccagaaaacggcacttatgatttctccatcctatgagatctagacaatttttgtcaaaaaatgggcaaatggtctgaggtgcctgacgtccaggcattcttttacacattggttcctccctagtctctgctcccagtgagactcgtcccaaatctttcttctttctctcctgtctgttccttcagtctccaccccaagctcttgagtcctttgaatccttcttttctacggactcatctgacctctccccttctccccaggctgctcctcgccaggccaagccaggtcccaattcttcctcagcctctgcttccgcaccctataatccttctatcacctcccctcctcacacccagtctggtttacagttttgttccgtgactagtcctcccccacttgcccaactatttcctcttaaagacgtggctggagctgaaggcatagtcaacgttaatgctcctttttcctctatcagacctttcccaaatcagccagcgtttaggctctttctcatcagaccccactaaatatatacaggaattccgatatctaactctgtcctacaatttaacctggagtgacttaaatgtcatcctgacttctaccctctccccggatgaatgggaaagagttttttctccagcccaatctcacactgataaccactggcttcatgagccagacctccaggaaggcattagagcagttccccgagaagatcccaatggaactatcaggcagattccccaggtatagctaggcgagattacatggtttcctgcctagttaaagggcttaaaaaggcagcttacaaagctgttatgacaaacttaaagaaactacccgaggtaaagacgaaagcccagcccagttcatggccctcttagcagcaaccctgagacactttactgccctagacccagaggggccagaaggccgtcttaatctcaatatgcattttattttattaaccaatttgctcccaacattaaataaagctccaaaaattaaattcggccctcgaaccccacaacaggacttaattaacctcgcttcaaggtgtacaataatagagtagaggcagccaagtagcaatgtatttctgagttgcaattccttgcctccactgtgagacaaaccccagccacatctccagcacacaagaactccaaacacctgaaccgccactgccaggggttcctccagaaactccttccccaggagcttgctacaagtgctggaaatctggccactgggccaagcaatgcccgcagcctgggactcctcctaagccatgtcccatctgtgcgggaccccagtggaaatcggactgtccaactcacctggcagccactcccggagcccctggaactctggcccaaggctctctgactgactcattcccagatattctcagcttagtggctaaagactgacgctgcctgatcacctcggaagccccctggaccatcacagaccctttgggtaactcttacagtggagggtaagtccgtctccttcttaatcaataaggaggctaccaactccacattaccttcttttcaaaggcctgtttcccttgcctccataactgttgttggtattgacggccaggcttctaaacctcttaaaactccccaactctggtgccaacttggacaatattcttttatgcactcattttagttatccccacctgcccagctctcttattaggtcgagacattttaactaaattatctgcttccctgactattcctaggctacaagcacacctcattgccacccttttccccagttcaaagcctcctttgcatcctcctctcgtatccccctaccttaacccacaagtatgggatacctctactccctccttggtgacaaatgatgcaccccttaccatcccattaaaacctaatcacccttaccccactcaatgccaatatcccatcccacagcatgctttaaaaggattaaagcctgttatcacttgcctgttacagcatggccttttaaagcctgtaaactctccctacaattcccccattttacctgtcctaaaacaagacaagccttaccttagttcaggatctgcgccttatcaaccaaattgtcttgcctatccaccccatggtgccaaacccatatactctcctatcctcaataccaccctccacaacccctccataaccccttattctgttctggatctcaaacatgctttctttactattccttgcacccttcatcctagactctctttgctttcacttggactgaccctgacacccattagactcacaaattacctgggctgtactgccacaaggcttcacggacagcccccattacttcagtcaagcccaaatttcttcctcatccattacctatctcgacataattcttcatgaaaatacacatgctctccctgctgatcacgtctgactaatctcccaaaccccaatgccttctacaaaacaacaactcctttccttcctgggcatggttggatacttttgcctttggatactggttttgccatcctaacaaaaccattatataaactcacaaaaggaaacctagctgaccccacagatcctaaatccttttgccactcctttccgttccttaaaaacagccctagaagctgcccccacactagctctccctaactcatcccaatcctttttcattacacacagccaaagtgcagggctgtgcagtcggaatttttacacaagagctgggactgcgccctgtagcctttttatccaaacaacttgaccttactgttttagcctagccttcatgtctgtgtgcagtggctgccgctgccttaatacttttagaggccctcaaaatcacaaactgtgctcaactcactctctatagttctcataacttccaaaatctattttcttcctcacacctgacgcatataatttctgcccccctccactacctctcagcaagccaaactcattgtcttaactcaagccctcactcttgcaaagggactacgcgtcaatatttatactgactgtaaatatgccttccatatcctgcaccaccatgctgttataagggctgaaagaggtttcctcactatgcaagggtcctccatcattaatgcctctttaataaaaactcttctcaaggccgctttacttccaaaggaagctgaagtcattcactgcaaaggccatcaaaaggcataagatgccatcactcagggcaatgcttatgctgacaaggtagctaaaaaagcagctagagttccaacttctaaccctcatggcagtttttctccttctcatctggtcattctcacctattcccccactgaaacttccacctatcaatctcttcccacacaaggcaaatggttcttggaccaaggaaaatatctccttccagcctcacaagcccattctagtctatcgtcatttcataacctcttccatgtaggttacaagcagctagcccgcctcttagaacttctcatttcctttccatcatggaaatctgtccttaaggaaatcacttctcagtgttccatctgctattctactactactcctcagggattgttcaggctgcctcccttccctacacatcaagctcggggatttgcccccgcccaggactggcaaattgactttactcacatgcctcaaatcaggaaactaaaatacctcttggtctgggtagacactttcactgggtgggtagaggcctttcccacagggtctgagaaggccaccgtggtaatttcttcccttctgtcaaacataattccttggtttggccttcccacttctatacagtccaataacagaccggcctttattagtcaaatcacccaagcagtttctcaggctcttggtatttagtggctccaggttttacctcaaactgccacccttaagtctctctttaagtggatagaagttcttcagtgacaaagtacactccaatactttcaccctgatgaagtcctattctttacttttatacttgctcttattcttgtccccatttttatgccactctctacctctccccagctatctccaccacactatatcagtctcagtcactctctcctagccatttctaatccttctttaacaaacaattgctggctttgcttttctctttcctccaaaattcccgaggccctgactaaaaaaggggtactcttgtatatttttaaatgaagaaaaaaaggggactctgtatatttttaaatgaagagtgttgtttttacctaaatcaatctggcctggtatatgacaacataaaaaaactcaaggatagcacccaaaaactcaacaaccaagcaaataattatgctgaactcccttggacactctgtaattggatgtcctgggtactcccaattcttagtcctttaatatctgtttttctccttctcttatttggaccttgtgtctttcatttagtttctcaattcatacaaaaccgcatccaggccatcaccaatcattctatacgacaaatgtttcttctaacaaccccacaatatcaccccttaccacaaaatcttccttcagcttaatctcacccactctaggttcccacgtcacccctaatcctgctcgaagcagccctgagaaacatcacccattatctctccataccacccccaaaaactttcgccaccccaacacttcaccactattttgttttatttttcttattaatataagaagacaggaatgtcaggcctctgagcccaagctaagccatcatatcccatgtgacctgcacatatacatccagatggcctgaagtaactgaagatccacaaaagaagtgaaaatagccttaactcatgacattccaccattgtaatttgtttctgtcccaccctaactgatcaatgtactttgtaa

SEQ ID NO: 110 - DNA, 751 bp, Homo sapiens
gagagacaggactagctggatttcccaggctgactaagaatccctaagcctagctgggaaggtgaccgcatccaccgctaaacacggggcttgcaacttagctcacaaccgaccaatcaggtagtaaagagagctcaccaaaatgctaattaggcaaaagcaggaggtaaagaaatagccaatcatctattgcctgagagcacagcgggagggacagtgatccggatataaacccaggcattcgagccggcaatggctaccctctttgggtcccctccgtttgtatgggagctctgttttcactctattaaatcttgcaactgcccactcttctggtccgtgtttgttatggctggagctgagctttcactcgccgtccaccactgctgtttgccgccgtcgcagacccgccgccgacttccatccctccggatccagcagggtgtccactgcgcttctgatccagcgaggcgcccattgccgctcccgatcgggctaaaggctcaccattgttcctgcacggctaagtgcccgggttcatcctaatcgagctgaacactagtcgctgggttccgcggttctcttctgtgacccacggcttctaatagagctatgacactcaccacatggcccaagggttcattccttggaatccgtgaagccaagaaccccaggtcagagagcaagaggcttgctgccatcttggaagccacccgccaccatcttgggagctctgggagcaaggaccccc

SEQ ID NO: 111 - DNA, 451 bp, Homo sapiens
gtcaggcctctgagcccaagccaagccatcgcatcccctgtgacttgcacgtatacgcccagatggcctgaagtaattgaagaatcacaaaagaagtgaaaatgcgctgccttgccttaactgatgacattccaccacaaaagaaatgaaaatggcctgttcctgccttaactgatgacattatcttgtgaaattccttctcctggctcatcctggctcaaaagctcccctactaagcaccttgtgacccccactcctgcccgccagagaacaacccccctttgactgtgattttcctttacctacccaaatcttataaaacggccccacccctatctcccttcgctgactctcttttcggactcaggccgcctgcacccaggtgaaataaacagccttgttgctctcacaaagcctgtttggtggtctcttcacaaggatgcaagtgaaa

SEQ ID NO: 112 - DNA, 997 bp, Homo sapiens
ggagttgtagggaaaagaaagagagatcagacagttattgtgcctatgtagaaaaggaagacataagaaactccattttgacctgtactctgaacaattgctttgccctgagatgctgttaatctgtaactttgccccaaccttgagctcacaaaaatatgtgttgtatggaatcaaggtttaagggatctagggctgtgcaggatgtgccttgttaacaaaatgtttacaggcagtatgtttggtaaaagtcatcgccattctccataaaccaggggcacaatgcactgcggaaagctgcagggacctctgccctggaaagccgggtattgtccaaggtttcttcccgtgtgatagcctgagatatggcctcaagggatgggaaagacctgaccgtcccccagcccgacacccatgaagggtctgtgctgaggaggattagcaaaagaggaaggcctcttgcagttgagataagaggaaggtctctgtctcctgcctgcccctgggaatggaatgtctcggtataaaacctgattgtacatttgttctattctgagataggagaaaagccgccctgtggcgggaggcgagacatgttggcagcaatgctgctctgcaactctttactccactgagatgtttgggtggagagaagcataaacctggcctatgtgcacatccaggcatagtaccttcccttgaacttatttgtgacacagattcctttgctcacatgttttcttgctgaccttctccccactatcaccctgctttcctactgcattcctcttgctgagacagtgaaaatagtaatcaataaatactgaggaaacccagagaccggtgccggtgctggtcctctgtatgttaagtgccggtctcctgggcccgctgttctttctctatactttgtctctgtgtcttatttcttttctcagtctctcatcccacccgacgagaaatacccacaggtgtggaggggcaggccaccccttca

SEQ ID NO: 113 - DNA, 5964 bp, Homo sapiens
gtcacgcctctgagcccaagccaagccatcgcatcccctgtgacttgcacgtatacccagatgacctgaagtaactgaagaatcataaaagaagtgaatatgccctgccccaccttaactgatgacattccaccacaaaagaagtgtaaatggctggtccttgccttaagtgatgacattaccttgtgaaagtccttttcctagctcatcctgactcaaaaagcacctccactgggcaccttgcgacccccactcctgcccgccagagaacaaaccccctttgactgtaattttcctttacctacccaaatcctataaaacggccccacccccatctcccttcactgactctatttttggactcagcctgcctgcgcccaggtgaaataaacagccatattgctcacacaaagcctgtttggtggtctcttcacacggacacgcatgaaatttggtgccgtgactcggatcgggggacctcccttgggagatcaatcccctgtcctcctgctctttgatccatgagaaagatccacctatgacctcaggtcctcagaccgaccagcccaagaaacatctcaccaatttcaaatccggtaagcagcctcttcttactctcttctccaacttccctcactatccctcaacctctttctcctttcaatcttggtgccacacttcaatctctcccttctcttaatttcaattcctttcattttctggtagagacaaaggagacatgttttatccgtggacccaaaactctggcaccggtcacggactgggaaggcagccttcccttgttgtttaatcattgcagggacgcctctctgattattaacccacgtttcaagggtgtcagaccatgcagggatgcctgccttggtccttcacccttagcagcaattcccgcttttctggggaaggggcaagtaccccaaccccttctctccttgtctctaccccttctctgcttttccagggacagggcaagtaccccaaccccttctctccttgtctctaccccttctcagcttttcttggagaggggcaagtacccctcaaccccttctccttcacccttagcgacaagtcccgcttttctgggggaggggcaagtaccactcaaccccttctccttcactcttagtggcaagtcccgcttttctagaggaggggcaagtaccccaacctcatatctctgtgccccaatcccttatttccatgccccaacctcatatctctgcaccccaatcccttatttccatgccccaacctcatatctctgcaccccaatcccttatttccacgccccgacctcttatttctgcgccccatcccttatttccgtgccctgacctcttatctctgagccccaaccccttttcccacttttctggaaggtaagaacccctgaaccccttccttccatttctctactctctcttttctctaggcttgcttccttcactatgggaaacttccaccctccattcctccttctactcccttggcctgtgttctcaaaaacttaaaacctcaactcacacctgacctaaaacctaaatgccttattttcttctgcaatgtctcttgaccccaatacaaactcgacagtagttccaaatagccagaaaatggcactttgaatttttccatcctgcaagatctaaataattcttgttgtaaaataggcaaatggtctgaggtgcctgatgtccaggtattcttttacacatcagtcccttcctagtctgtgcccattgcaactcgtcccaaatcttccttctttccctcccgcctgtcccctcagtaccaaccccaagcgtcactgagtctttctaatcttccttttctacagacccatctgacctctcccttcctccccaggctgctccttgccaggccgagctaggtcccaattcttcctcagcctctgctcctccaccctgtaatcctttcatcacctcccctcctcacacctggtccggcttacagtttcgttcagtgactagccctccccctcctgcccagcaatttactcttaaaacggtggctggagctaaaggcatagtcaaggttaatgctcctttttctttatcccaaatcagaagcgtttaggatctttttcatcaaatataaaaacccagcccagttcatgactcctttggcagcaaccctgagacactttacagccctagaccctaaaaggtcaaaaggccgtcttattctcaatatacattttattacccaatctgctcccgacactaaataaaactccaaaaattaaattccagccctcaaaccccacaacaggatttaatgaacctcgccttcaaggtgtacaataatagaaaaaagttgcaattccttgcctccactgtgagacaaaccccagccacatctccagcacccaagaacttccaaacgcctgaaccacagcggccaggcgttcctccagaacctcctcccacaggagcttgctacatgtgccggaaatctggccactgggccaaggaatgcccgcagcccgggattcctcctaacctgtgtcccatctgtgtgggaccccactgaaaattggactgttcaactcacctggcagccactcccagaggccctggaactctggcccaaggctctctgactccttcgcagatcttctcggcttagcggctgaagactgacgctgccggatcgcctcggaagccccctagaccatcacggacgccgagcttccggtaactctcacagtggaaggtaagcccgtccccttcttaatcaatacggaggccacccacgccacattaccttcttttcaagggcctgtttcccttgcctccataactgttgtggatattgacggccaggcttctaaacctcttaaaactccccaactctggtgccaacttagacaatactcttttaagcactcctttttagttatccccacctgcccagctcccttattaggctgagacactttaactaaattatctgcttccctgactattcctggactacagctatgtctcattgccgcccttcttcccaatccaaagcctcctttgtgtcctcctcttgtatccccccaccttaacccacaagtataagatatctctactccctccttggcgaccggtcatgcaccccttaccatctcattaaaacctaatcacccttaccccactcaacgccaatatcccatcccacagcacgctttaaaaagattaaagcctgttatcactcgcctgctaaagcatggccttttaaaacctataaactctccttacaattcccccattttacctgtcctaaaaccagacaagccttacaatttagttcaggatctgcgccttatcaaccaaattgttttgcctatccaccccatggcgccaaacccatatactctcctatcctcaatacctgcctctacaacccattattctgttctagatctcaaacatgctttctttactattcctttgcacccttcatcccagcctctcttcactttcatttggactgaccctgacacccatcaagctcagcaaattacctaggctgtactgctgcaaaggttcacagacagcccccattacttcaatcaagcccaaatttcttcctcatctgttacctatctctgcataattctcataaaaacacacgtgctctccctgccaatcgtgtccgactgatctctcaaacccaagcaccttctacaaaacgacaactcctttccttcctaggcatggttagcgcggtcagaattcttacacaagagccaggacaacaccctgtaggctttctgtccaaacaacttgaccttactgttttagcctagccctcatgtctgcatgcagcggctgccactgctttagtacttttagaggccctcaaaatcacaaactgtgctcaactcattctctacagttctcctaacttccaaaatctattttcttcctcatacctgatggatatactttctgcttcctggctccttcagctatactcacactttgttgagcctcccacaattaccattgttcctggcccagacttcaatccggcctcccacattattcctgataccacacctgacccccatgactatctctctgatccacctgacattcaccccgtttccccaaatttccttctttcctattcctcaccctgatcatgcttgatttattgatggcggttccaccaggcctaatcgccacacaccagcaaaggcaggttttgctatagtacaagccactagcccacctcttagaacctctcatttcttttccatcgtggaaatctatcctcaaggaaataacttctcagtgttccatctgctattctactactcctcagggattattcaggcctcctcccttccccacacatcaagctcgaggaattgccccacccaggactggcaaattagctttactccacatgccctgagtcagaaaactaacatatctcttggtctaggtagacactttcactggataggtacaagcctttcctacagggtctgagaaggccaccgcagtcatttcttccattctgtcagacataattcctcagtttagccttcccacctcaatacagtctgataacagatgagccttcattagtcaaatgagccaagcagtttttcaggctcttagtattcagtgaaacctttatatcccttacggtcctccatcttcaagaaaagtagaaaggactaatggtctattaaaaacacacctcaccaagctcagccaccaacttaaaaaggactggacaatacttttaccactttcccttctcagaattcaggcctgtccttagaatgctacagggtacagcccatttaagctcttgtatagacgctcctttttattaggccccagtctcattccagacaccagaccaacttggactgtgccccaaaaaacttgtcatccctactatcttctgtctagtcatactcctattcaccgttctcaactactcatacatgccctgctcttgtttacactgctggtttacactgtttttccaagccatcacagctgatatctcctggtgctatccccaaactgccactcttaactcttgaagtaaataaataatctttgctggcaggactatgctgaatctccttaggcactctctaatcagatatcctgagtcatcccaattcttagacattttatacctgtttttctccttctgttattccatttagtttctcaattcatccaaaaccgtatctaggccatcaccaatcattctatatgacaaatgtttcttctaacatccccacaatatcaccccttaccacaagacctcccttcagcttaatctctcccactctaggttcccaagccacccctaatcccgcttgaaacagccctcagaaacatcgcccattctctctccataccaccccccaaaaattttcgctgccccaacacttcaacattattttgttttatttttcttattaatatcagaaggcaggaatgtcaggcctctgagcccaagccaagccatcacatcccctgtgacttgcacgtatatgcccagatggcctgaagtaactgaagaatcacaaaagaagtgaatatgccctgccccaccttaactgatgacattccaccgcaaaagaagtgcaaatggccagtccttgccttaagtgatgacattaccttgtgaaagtccttttcctggctcatcctggctcaaaaagcacccccactgaacaccttgcgacccccactcctgcccgccagagaacaaaccccctttgactgtaattttcctttacctacccaaatcctataaaacggccccacccctatctcccttcactgactctcttttcggactcagcctgcctgcacccaggtgaaataaacagccatgttgctcacacaaagcctgtttggtggtctcttcacacggacgcgcatgaaa

SEQ ID NO: 114 - DNA, 390 bp, Homo sapiens
gtcaggcctctgagcccaagctaagccatcatattccctgtgaccggcaggtatacatacagatggcctgaagtaactgaagaatcacaaaagaagtgaaaatggcctgttcctgccttaactgatgaccttaccttgtgaaattccttctcctggctcaaaagctcccccactgagcaccttgtgacccccacccctgcctgccagagaacaaccgcctttgactgtaattttccactacctacgcaaatcctataaaacggccccacccctatctcccttcgctgactctcttttcggactcagcccgcctgcacccaggtgaaataaacagccttgttgctcacacaaagcctgtttggtggtcttgtcacacggacgcaagtgaaa

SEQ ID NO: 115 - DNA, 746 bp, Homo sapiens
gaaagacaggactagctggatttcctaggctaagaatccctaagcctagctgggaaggtgactacatccacctttaaacacgggacttgcaacttagctcacaccccaccaatcaggtggtaaagagagctcactaaaaagctaattaggcaaaaacaggaggtaaagaaatagccaatcatctattgcctgagagcaagctggagggataatgatcaggatataaacccaggcattcgagccggcaacagctaccctctttgggtcccctccctttgtatgggagctctgttttcactctattaaatcttgcagctgcactctcttctggtccgtgtttgttacggctggagctgagcttttgcttgccgtccaccactgctgtttgccgatgtcgcagacccaccgctgatttccatccctctggatccagcagggtgtctgctgtgctcctgatccaggaggcgcccattgctgctcctgactgggctaaaggcttgccattgttcctgcacagctgagtgcccgggttcatcctaattgaactgaacactagtctctgggttcaatggttctcttctgtgacccacggcttctaatagagctataacactcaccgcatggcccaagattccattccttggaatccgtgaggccaagaaccccaggtcagaaaaaacaaggcttgccaccgtcttggaagcagcccaccaccatcttgggagctctgggagcaaggacccctc

SEQ ID NO: 116 - DNA, 5596 bp, Homo sapiens
gtcaggcctctgagcccaagctaagccatcatatcccctgtgacctgcacgtacacatccatatggctggttcctgccttaactgatgacattccaccacaaaagaagtgaaaatggcctgttactgccttaactgatgacattgtcttgtgaaattccttctcctggctcatcctggctcaaaagctcccctacagagcaccttgtgacccccactctgcccgccagagaacaaccccgctttgactgtaattttcctttacctacccaaatcctataaaacggccccaccccatcccccttcgctgactctcttgtcggactcagcccacctgcacccaggtgattaaaagctttattgctcacacaaagcctgtttggtggtctcttcacatggacgcacatgaaatttggtgccgtgacttggatcgggggacctcccttgggagatcaatcccctgtcttgctctttgctctgtgaaaaagatccacctacgacctcaggtcctcagacccaccagcccaaggaacatctcaccaagtttaaattgggtaagcgacctcttcttactctcttctccaacctctctcactgtccctcaaccactttctcctttccactcttcaatctctcccttctcttaatttcaattcctttcattttctggtagagacaaaggagacacgttttatctgtggacccaaaactccggcgccggtcacggactagggaaggcagccttcccttggcgtttaatcattgcagggacgcctctctgattatatacccacgcttcagaggtgtcagatcacgcagggatgcctgccttggtccttcacccttagtggcaagtcccacttttctggggaaggggcaagttccccaacccctcctctccatgtctctaccccttctccacctttctggggggcaagaaacccccaaccccttctccttcactcttagcggcaagtcccgcttttctagaggggcaagtaccccaacctcgtatctctgcaccctgatcccttatttccatgccccaacctcttatctctgtgccccaaccccttatatccatgccccaacccctttcccgcttttctggaaggtaagaactcccgaaccccttccctccgtgtctctactctctcttttctctaggcttgcctccttcactatgggcaaccttccaccctccattcctcctccttctctcccttggcctgtgttctcaaaaacttaaaacctcttcaactcacacctgacctaaaacctaaatgccttattttcttctgcaatgccgcttgaccccaatacaaactggacagcagttccaaatagccagaaaacagcactttcaatttttccatcctgcaagatctaaataattcttgtcgtaaaatgggcaaacggtctgaggtgcctgacgtccaggcattcttttacacatcagtcccttcctagtctctgtgcccagtgcaactcgtcccaaatcttccttctttccctcctgcctgtcccctcagtctcaaccccaagcgtcgctgagtctttctaatcttccttttctacagacccgtctgacctctccctcctccccaggctgagctaggtcccaattcttcctcagcctccgctcctccaccgtattatctttttatcacctcccctccccacacctggtccagcttacagtttcgttcagtgactagccctcttccacctgcccagcaatttactcttagaaaggtggctggagctaaaggcatagtcaaggttaatgctcctttttctttatcccaaatcagatagtgtttaggctctttttcatcaaatataaaaatccagcccaattcatggctcgttcgccagcaaccctgagaagctttacagccctagacccttaaaagtcaaaaggccgtcttattcttaatacacattttattacccaatctgctcccgacattaaataaaactccaaaaattaaattccggccctcaaaccccacaacaggatttaattaacctcgccttcaaggtgtacaataatagaaaaaagttgcaattccttgcctccactgtgagacaaaccccagccacatctccagcacacaagaagggaactgaaccgcagcggccaggcgttcctccagaacctcctcccccaggagcttgctacaagtgccagaaatctgaccaccaggccaaggaatgcctgcagcccaggattcctcctaagccgtgtcccatctgtgcgggaccccactggaaatcggactgttcaactcacctggcagccactcccagagcccctggaactctggcccaaggctctctgactccttctcggcttagcggctgaagactgatgctgcccaatcgcctcggaagctctgtagaccatcacggatgccgagcttcgggtaacactcacggtggaaggtaagtccgtcgccttagtcaatacggaggctacccactccacattaccttcttttcaagggcctgtttctcttgcctccataactgttgtgggtattgacggccaggcttctaaacccctgaaaactcccccactctggtgccaacttggacaacactcttttatgcactcttttttagttatccccacctgcccagttcccttattaggccgagatattttaaccaaattatctgcttccctgactattcctggactacagccgcatctcattgccacccttctcctcaacccaaagcctccttcgcgtcttcctctcctattcccccaccttaacccacaagtatgggacatctctactccttccctggcaactgatcacatacccgttaccatcccattaaaacctaatcacccttaccctgctcaatgccaatatcccatcccacagcacactttaaaaggattaaagcctgttatcactcgcctgctatagcatgggcttctaaaacctataaactctccttacaattcccccattttacctgtccaaaaaccggaaaagtcttacagattagttcaggatctgcgccttatcaaattgttttgcctatgcaccctgtggtgcccaacccctacactcttttgtcctcaataccttcctccacaactcactattccatgcttgatcttaaagatgcttttttcactattcccctgcacccctcgtcccagcctctcttcgctttcacttggactgaccctgacacccattaggctcagcaaattacctgggctgtactgctgcaaggtttcacagacagcccccattacttcagtcaagcccaaagttcatcctcatctgttacctatctcggcataattctcataaaaacacacgtgctctccctgctgatcgtgtctgactgatctctcaagccccagcaccttctacaaaacaacaactcctttccttcctaggcatggttagcgcggtcagaactcttacacaagagccaggaccacaccctgtagcctttctgtccaaacaacttgaccttactgttttagcctagccctcatatctgcgtgctgtggctgccgctgctttaatacttttagaggccctcaaaatcacaaactatgctcaactcactctctacagctctcataatttccaaaatctattttcttactcacacctgatgcatatactttctgctccctggctccttcagctgtactcactctttgttaagtcccacaattaccattgttcctggcccggacttcaatctggcctcccacattattccagataccacacctgacccccatgactgcatctctctgatccacctgacgttcaccccatttccccacatttccttcttccctgtttctcaccctgatcacacttagtttattgatggcggttccaccaggcctaatcgccacacaccagcaaaggcaggctatgctatggtacaagccactagccagcctcttagaacctctcatttcctttccattgtggaaatctatcctcaaagaaatcacttctcagtgttgcatcagctattctactactcctcatggattattcaggccccctcccttccctacacatcaagctcaaggatttgcccccgcccaggactggcaaattagctttactcaacatgccccgagtaagataactaaaatacctcttagtctaggtagacactttcactgggtaagtacagtcctttcctacagggtctgagaaggccaccgcagtcatttcttcccttctgtcagacataattcttcagtttagccttgtcattcccttctgtcagacaaaattcctcagttcagccttcccacctctatacagtctgctaacagaccagcctttattagtcaaatcagccaagcattttttcaggctcttagtattcagtgacagactaatggtctattaaaaacacacctcaccaagctcagccaccaacttaaaaaggactggacaatacttttaccattttcgcttccagaattcaggcctgtccttggaatgctacaagatacagcccatttaagctcctgtgtagacactcctttttattaggccccagtctcattccagacaccagaccaacttagattgtgccccaaaaaacttgtcatccctactatcttctgtctagtcatactcctattcaccgttctcaactactcacacatgccctgctcttgtttacactgccagtttacactgtttctccaagccagcacagctggtatctcctggtactatccccataccgccactgttaactcttaaaataaataaataatctttgctggcaaggctatgctgaacctccttaggcactttctaattagatgtcctgagtcgtcccaattcttagacctttaatacctgtttttctcctttccttattccctttagtttttcaattcatacaaaactgtatccaggccatcaccaataattctaaatgacaaatgtttcttttaacaatcccacaatgtcaccccttaccacaaaatcttccttcagcttaatcgctcccactttaggttcccacgccgcccctaatcctgctcaaagcagccttgagaaacatcacccattatctctccataccacccccaaaaatttttgctgtcccaacactttacccctatttcattttatttttcttattaatataagaagacaggaatgtcaggcctctgagcccaagctaagccatcatatcccctgtgacctgcacgtacacatccagatggccggttcgtgccttaactgatgacattccaccacaaaagaagcgaaaatggcctgttcctgccttaactgatgacattgtcttgtgaaattccttctcctggctcatcctggctcaaaagctcccctactgagcaccttatgaccccgactctgcccgccagagaacaacccccctttgactgtaattttcctttacctacccacatcctataaaacggccccacccctatcccccttcgctgactctcttgtcagactcagcccacctgcacccaggtgattaaaagctttattgctcacacaaagcctgtttggtggtctcttcacacggacgtgcatgaaa

SEQ ID NO: 117 - DNA, 6146 bp, Homo sapiens
gtcaggcctctgagcccaagctaagccatcatatcccctgtgacctgcacgtacacacccagatggccagttcctgccttaactgatgacattccaccacagaagaagtgaaaatggcctgttcctgccttaactgatgacactgtcttgtgaaattccttctcctggctcatcctggctcagaagctcccctactgagcaccttgtgacccccactctgcctgccagagaacccccatttgactgtaattttcctttatctacccaaatcctataaaacggccccacccctatctcccttctctgactctcttttcagactcagccagcctgcacccaggtgattaaaagctttattgctcacacaaagcctgtttggtgatttcttcacacagactcacatgaaatttggtgccatgactcggatcgggggacctcccttgggagatcaatcccctgtcctcctgttctttgctccgtgaaaaagatccacctacgacctcaggtcctcagacccaccagcccaaggaacatctcaccaattttaaatcaggtaagtggcctcttcttactctcttctccaacctctctcactatccctcaaccactttctcctttccactcttcagtctctcccttctcttaatttcaattcctttcattttctggtagagacaaaggagacacgttttgtctgtggacccaaaactccggcgccggtcacggactgggaaggcagccttcccttggtgtttaatcattgcagggacacctctctgattattcacccacgtttcagaggtgtcagaccacgcaaggatgcctgccttggtccttcacccttagcggcaagtcccgcttttctaggggaggggcaagtaccccaaccccttctctccatgtctctaccccttctctgcctttctggggggcaagaaacccccaatcccttctccttcacccttagtggcaagtcccgcttttctggtggagaggcaagtaccccaacctcatatctctgtgccccgatcccttatttctgtgccccgacctcttatatctctgcgccctgatcccttatttctgcggcccgacctcttatatctctgtgccctgatcccttatttccgctccccaccctcttatatctctgtctcctgatcccttatttccatgctccgacctcatatctctgcgccctgacccctttcctgcttttctggagggtaagaacccccgaaccccttccctccatgtctccactctctcttttctctgggcttgcttccttcactatgggcaaccttccaccttccattcctccttcttctcccttagcctgtgttctcaaaaacttaaaacctcttcaactcacacctgacctaaaacctaaatgccttattttcttctgcaatgccacttgaccccaatacaaactcgacagtagttccaaatagccagaaaacagcactttcaatttttccatcctgcaagatctaaataattcttgtcctaaaatgggcaaacggtctgaggtgcctgatgtccaggcattcttttacacatcggtcccttcctagtctctgtgcccagtgaaactcatcccaaatcttccttctttccctctcgcctgtcccctcagtcccaaccccaagcgtcgctgagtctttctaatcttccttttctacagacccatctgacctctcccctcctccccaggctgctcctcgccaggccgagctaggtcccaattcttcctcagcctccgctcctccaccctataatctttttatcacctcccctcctcatacccggtccggtttacagtttcattccgtgagtagccctcccccacctgcccagcaatttcctcttaaaaaggtggctgaagctaaaggcatagtcaaggttaatgctcctttttcttcatcagacctctcccaaatcctgagcatttaggctctttcatcaaatatgaaaaacccagcccagttcatggcttgttcagcagcaaccctgagacgctttacagccctagaccctgaaaggtcaaaaggccgtcttattctcaatatacattttattacccaatctgctcctgacattaaataaaactccaaaaattaaattccggccctgaaaccccacaacagggcttaattaacctcaccttcaaggtgtacaataatagagacagccaagtagcaacatatttctgagttgcaattccttgcctccactgtgagacaaaccccagccacatctccagcacacaagaacttccaaacacctaaactgcagtggccaggtgttcctccagaaccgccttccccaggagcttgctataagtgccagaaatctggacaccaggccaaggaatgcccacagcccgggattcctcctaagccatgtcccatctgtgcgggaccccactggaaattggactgttcaactcacctggcagccactcccagagcccctggaactctggcccaaggctctttgactgactgcttcccagatctcggcttagcagctgaagactgccactgccagatcgcctcgaagcctacaagaccattacagacactctgggtaactctcacagtggaaagtaagtccgtccccttcttaatcaatacggaggctacccaccccacattaccttattttcaaaggcctgtttcccttgcttccataactgttgtgggtattgatggccaggcttttaaacctgttaaaactccccaactctggtgccaacttagacaatattcttttaagcactccttttcagttatccccacctgcccagttcccttattaggccgagatattttaaccaaattatctgcttccctgactattcctggactacagccgcatctcactgctgcccttctccccaacccaaagcctccttcgcgtcttcctctcatatccccccaccttaacccacaagtatgggacatctctactccttccctggcaacagatcacatgcccattaccatcccattataacctaatcacccttaccccgctcaacaccaatatcccatcccatagcacgctttaaaaggattaaagcctgttatcactcgcctgctacagcatgggcttctaaaacctataaactctccttacaattcccccattttacctgtcctaaaaccgcacaagtcttacaggttagttcaggatctgcgccttatcacccaaattgttttgcctatccaccctgcggtgcccaacccgtacactcttttgtcctcaataccttcctccacaactcactattccattcttgatcttaaagatgcttttttcactattccccttcacccctcgtcccagcctctctttgctttcacctggactgaccctgacacccatcagtcccagcagcttacctgggctgtgctgccgcaaggtttcagggacagccctcattacttcagccaagctctttctcatgatttactttctttctacccctccgcttctcaccttattcaatatattgatgaccttcttctttgtagcccctcctttgaatcttctcaacaagacacacttctgctccttcagcatttattctccaaaggatatcgggtatccctctccaaagctcaaatttcttctccatccgttacctaccttggcataattcttcataaaaatacacgtgctctccctgctgatcgtgttggactaatctctcaaaccccaaccccttctacaaaataacaactcctttccttcctgggcatggttggatattttcgcctttagatacctggttttgccatcctaacaaaaccattatataaactcacaaaaggaaacctagctgaccccatagatcctaaatcctttccccactcctctttctgttccttgaagacagctttagagactgcccccactctagctctccctgactcatcccaacccttttcattacacacagccgaagtgaagggccgtgcagtcagaattcttacacaaggaccgggatcacgtcctgtagcctttttgctcaaacaacttgactttactgttttaggctggccatcatgtctccgtgcagcggctgctgccgccctaatacttttagaggcccttaaaatcacaaactatgctcaactcactctctacagctctcataatttccaaaatctattttcttcctcacacctgacacatacactttctgctccccagctccttcagcagtactcactctttgttgagtctcccacaattaccattgttcctggcccggacttcaatccagcctcccacagtattgctgataccacacctgaccctcatgactgcatctctctgatccacctgacgttcaccccatttccccacatttccttcttccctgtttctcaccctgatcacagttggtttattgatggcagttccaccaggcctaatcgccactcaccagcaaaggcaggctatgctatagtacaagccactagcctgcctcttaaaacctctcatttcctttccattgtggaaatctatcctcaaggaaataacttctcaatgttccatctgctattctactactcctcagggattattcaggccccctcccttccctacacatcaagctcgaggatttgcccccacccaggactggcaaattagctttactcaacatgccccgagtcagataactaaaatacctcttagtctaggtagatactttcactggataggtacaggcctttcctacagggtctgagaaggccactgcagtcatttcttcccttctgtcagacataattcctcagtttagccttcccacctctatacagtctgacaacggaccagcctttattagtcaaatcagacaagcagtttttcaggctcttagtattcagtgaaacctttatatcccttacggtcctccgtcttcaagaaaagtagaacggactaaaggtcttttaaaaacacacctcaccaagctcagccaccaacttaaaaaggactggacaatacttttaccactttcccttctcagaagtcagacctgtcctcagaatgccacaaggtacagtccatttgagctcctgtatggacactcctttttattaggccccagtctcattccagacaccagaccaacttagactgtgccccaaaaaaacttgtcatccctactatcttctgtctagtcatactcctattcactgttctcaactactcatacatgccctgctcttgtttacactgccggtttacactgtttctccaagccatcacagctgatatctcctggtactgtccccaaactgccactgtaaactcttgaagtaaataaataatctttgctggcaggactatgctgaatctccttaggcactctctaatcagatgtcctgggtcctcccaattcttagaccttttatacctgtttttctccttctcttattccatttagtttttcaattcatacaaaactgtatccaggccatctccaataattctacacgacaaatgtttcttctaacaaccccacgacatcacctcttaccacaaaatcttccttcagcttaatctctcccactctaggttcccacgctgcctctaataccgcttgcagcagccctgagaaacatcgcccattatctctccacaccacccccaaaaattttcaccatcccaacactttaccactatttcattttatttttcttattaacataagaagacaggaatgtcaggcctctgagcccaagctaagccatcatatcccctgtgacctgcaggtacacacccagatggctggttcctgccttaactgatgacattccaccacaaaagaagtgaaaatggcctgttcctgccttaactgatgacattgtcttgtgaaattccttctcctggctcatcctggctcaaaagctcccctactgagcaccttgtgacccccactttgcccgccagagaacaacccccctttgactgtaattttcctttatctacccaaatcctataaaatggctatacccttatctcctttctctgactctcttttcgaactcagcctgcctgcacccaggtgaaataaacagccatgttgctcacacaaagcctgtttggtggtctcttcacactga

SEQ ID NO: 118 - DNA, 6032 bp, Homo sapiens
gtcaggcctctgagcccaagctaagccatcatatcccctgtgacctgcatgtacacatccaggtggctggttcctgccttaactgaggacattccaccaccaaagaagtgaaaatggcctgttcctgccttaactgatgacattgtcttgtgaaattccttctcctggctcatcctggctcaaaaactcccccactgagtaccttgtgacacccagtcctgcccaccagagaacaactcccctttttcctttacctacccaaatcctataaaagggccccacccctatcttcctttgctgactctcttttcagactcagcccacctgcacccaggtgaaataaacagctttattgctcacacaaagcctgtttggtggtctcttcacatggatgggcatgaaatttgttgccgtgactcagattgggggacctcccttcggagatcgatcccctgtcctcctgctctttgctccgtgagaaaggtccacctacaacctcaggtcctcagactgatgagcccaagaaacatctcaccaatttcaaatccagtaagcggcctcttttaactctcttctccaacctctctcactgtccctcaacctctttctcctttcaatcttggcgccacacttcaatttctcccttctcttaattttaattcctttcattttctggcagagacaaaggagacacgttttatccgtggacccaaaactccggtgctggtcacagactagggatggcagccttccctttgtgtttaatcattgcagggatgcctctctgattattcacccaggtttcagaggtgtcagaccacgcagggatgcctgccttggtccttcacccttagtggcaagtcctgtttttctgggggaggggcaagtaccccaaccccttctctccgtgtctctaccccttctccacttttctgggggaggggcaagaacccctcaaccccttctccttcacccttagcagcaagttccatttatctagggggcaagaaaccccaatcccttatttccatgccccgacctcttatctctgcaccccaatccttatttctgtgccccaaagtcttatctctgcaccccaaccccttatttccacaccccaacccctttcccacttttctggagggtaagaacccctgaaccccttccctccatgtctctactctctcttttctctgggcttgcttccgtcactataggcaaccttccaccctccattcctgcttcttctctcttagccagtgttctcaagaacttaaaacctcttcaactcacacctgacctaaaacctaaatgccttattttcttctacaatgccacttgaccccaatacaaacttgacagtggttccaaatagccagaaaatggcatttccattttttccatcctacaagatctaaataattcttgttgtaaaatagccaaatagtctgaggtgcctgacgtccaggcattcttttacacatcagtccctccctagtctctgttcccaatgcaactcatcccaaatcttccttctttcccttccacctgtcccctcagtcccaaccccaagtgtcgctgagtctttctaatcttccttttctacagacccatctgatctctccccttctagccaggccaagctaggtcctaattcttcctcagcctccactcctccaccctataatccttttatcacctcccctcctcacactctgtccaggttacagtttccttccgtgactagccctcccccacctgcccagcagtttactcttaaaaaggtggctggagctaaaggcatagtcaaggttaatgctcctgtttctttatcccaaatcagatagcgtttaggctctttttcatcaaatataaaaacccagcccagttcatggctcatttggcagcaaccctgagatgctttacagccctagaccctaaaaagtcaagaggccgtcttattcttaatacacattttattacccaatctgctcctgacattaaataaaactccaaaaattaaattccggccctcaaaccccacaacaggacttaattaaccttgccctcaaggtgtgcaataatagaggcagccaagtagcaacatatttctgagttgcaattccttgcctccactgtgagacaaaccccagccacatctccagcacacaagaacttccaaatgcctaaaccacagtggccaggcattcctccagaactgcctcccccaggagcttgctacaagtgccagaaatctggccaccaggccaaggaatgcccgcagcctgggattcctcctaagccatgtcccatctgtgtgggatcccagtggaaatcagactgttcaactcacctggtagccactcccagggcccctggaactctggcccaaggctctctgactccttcccagatcttctcggcttagcggctgaagactaacactgcctgattacctcggaagccctgtagaccatcacggacaccgagctttaagtaactctcacagtggagggtaagtccgtccccttcttaatcaatacagaggctacccactccacattaccttcttttcaagggcctgtttcccttgcctccataactgacagccaggcttctaaacctcttaaaactccccaaactggtgccaacttagacaatactcttttaagcactccttttagttatccccacctgcccagttcctttattaggccgagacactttaactaaattatctgcttccctaactattcctggactacagctatatctcattgctgcccttcttcccaatccaaagcctcctttgcatcctcctcttgtattaccccaccttaacccacaagtataagatacctctactccctccttggcgaccaatcatgcaccccttaccatctctttaaaacctaatcactcttaccctgctcaatgccaatatcccatcccacagcatgcttagaaaggattaaagcctgttatcactcacctgccacaccatggccttttaaagcctgtaaactctccttacaattcccccatttttcctgtcctaaaaccagaaaagccttacaggttagtttaagacctgcaccttatcaaccaaatagttttgcctatccgccccatggtgccaaacccatatactctcctatcctcaatacctccctccacaatccattattctgttctggatctcaaacatgctttctttactattcctttgcacccttcatcccagcctctctttgctttcacctggactcaccctgacacccatcagtcccagcagcttacctgggctgtgctgccacaaggtttcaaggacggccctcattacttcagccaagctctttctcatgatttactttctttctacccctccgcttctcactttattcaatatattgatgaccttcttctttgtagcccctcctttgaatcttctccacaagacacacttctgccccttcagcatttattctccaaaggatatcaggtatccccctccagagctcaaatttcttctccaactgttacctacctcagcataattcttcataaaaatacacgtgctctccctgccgatagtgtccggctaatctcccaaagcccaatcccttctacaaaacaacaactcctttccttcctaggcatggttggatactttcgcctgtggatacctggttttgccatcctgacaaaatcattatataaattcacaaaaggaaacctagctgaccccatagatcctaaatcctttccccagttctctttccattccttgaagacagctttagagactgcccccactctagctctccctaactcatgccaatcgttttcattacacacagccgaagtgcagggctgtgcagtcagaattcttacacaaggaccgggatcgcatcctgtagcctttttgtccaaacaacttgaccttactgttttaggttggtcatcatgtctccgtgcagcagctgctgccgccctaatacttttagaggcccttaaaatcacaaactgtgctcaactcactctctacagctctcataatttccaaaatccattttcttccaaacacctgacacatatactttctgctccctggctcctttagctgtactcactctttgttgagtctcccacaattaccattgttcctggcccaacttcaatccggcctcccacattattcctgataccacacctgaccctcatgactgcatctctctgatccacctgacattcaccccatttccccacatttccttcttccctgtttctcaccctgatcacacttggtttattgatggtagttccaccaggcctaatcaccacacaccagcaaaggcaggctatgctatagtacaagccactagcccgcgtcttaaaacctctcatttcctttccatcatagaaatctgtcctcaagtaaataacttctcagtgttccatctgctattctactacccctcagggattattcaggccccctcccttccctacacatcaagctcagggatttgaccccacccaggactggcaaattagctttactcaacatgccccgagtcacaaaaactaaaacacctcttagtctaagcagacactttcactagataggtagaagcctttcctacagggtctgagaaggccactgcagtcatttcttcccttctgtcagacataattcctcagtttagccttcccaccgctatacagtctgataactgaccagcctttattagtcaatcagccaagcagtttttcaggctcttagtattcagtgaaatctttatattccttacagtcctcagtcctcaggaaaagtagaacagactaaaggtcttttaaaaacacacctcaccaagctcagccaccaacttaaaaaagaacagacaatacttttaccactttcccttctcagaattcaggtgtgtcctcagaatgctacaaagtacagcccatttaagctcctgtatagatgcacctttttattaggcccccgtctcattccagacaccagaccaacttggattgtgccccaaaaaacttgtcatcactactgtcttctgtctagtcatactcctattcaccgttctcaactactcatacatgccctgctcttgtttacactgccagtttacactgtttctccaagccatcacagctgatatctcctggtgctatccccaaaccgccactctaactcttaaagtaaataaataatctttgctggcagggctatgctgaacctccttaggcactctctaattagatgtcctggatcctcccaattcttattcctttagtacctgtttttctccttatcttattccgtttagtttttcaattcatacaaaaccatatccaggccatcaccaataattctaaatgacaaatgtttcttctaacaaccccacaatatcaccccttaccacaaatcttccttcagtttaatctctcccactctaggttcccacgctgccccaatcccgctcgaagcagccctgagaaacatcgcccattatctctccataccattccccaaaattttcgccgtcccaacattttaccactatttcattttatttttcttattaacataagaagacaggaatgtcaggcctctgagcccaagctaagccctcatatcccttgtgacctgcacgtacacatccaggtggccggttcctgccttaactgctgacattcgaccacaaaagaagtgaaaatggcctgttcctgccttaactgatggcattatcttgtgaaattccttttcctcgctcatcctggctcaaaagctcccccactgagtaccttgtgacccccccactcctgcccgccagagaagaacccccctttttcctttacctatccaaatcttataaaacagccccacccctatctcccttcactgactctcttttcggactcagcccacctgcacccaggtgaaataaacagctttattgctcacacaaagccggtttggtagtctcttcacacggatgcgcatgaaa

SEQ ID NO: 119 - DNA, 961 bp, Homo sapiens
gtagggaaaagagagatcagactgtaactgtgtctacatagaaagaagtagacataagagactccattttgttctgtactaagaaaaattcttctgccttgagatgctgttaatctgtaaccctacccccaaccctgtgctcgcagaaacatgtactgtgtggactcaagttttaatggatttagggctatgcaggatgtgctttgttaaacaaatgcttgaaggcagcatgcttgttaaaagtcattaccactccctaatctcaagcacccagggacacaaaacactgcagaatgccacagggacctctgcctaggaaagccaggaattgtccaaggtttctcctcatgtgatagtctgaaatatggcctcgtgggaagggaaagacctgaccgtcccccagcctgacacccgtaaagggtctgtgctgaggaggattagtaaaagaggaaggcctctttgcagttgagataagaggaaggcatctgtctccagctcgtccctgggcaatggaatgtctcggtgtaaaacccgattgtatattccatctactgagataggagaaaactgccttagggctggaggtgagacatgctcgtggcaatactgctctttaatgcattgagatgtttatgtatgtgcacatcaaagcacagcacctttttctttaccttgtttatgatacagagacatttgttcaaatgttttcctgttgaccctctccccactattatcctattgtcctgccacatccccctctctgagatggtatagataatgatcaataaatactgagggaactcagagaccggtgccggagtgggtcctccgtatgctgagcgctggtcccctgggcccacttttctttctctatgctttgtctttgtgtctctctcttttctcagtctctcatcccacccaatgggaaacacccacaggtgtggaggggcaggccacccct

SEQ ID NO: 120 - DNA, 8720 bp, Homo sapiens
tggggcaaactaaaagtaaaattaaaagtaaatatgcctcttatctcagctttattaaaattcttctaaaaagagggggagttaaagtatctacaaaaaatctaatcaagctatttcaaataatagaacaattttgcccatggtttccagaacaaggaactttagatctaaaagattggaaaagaattggtaaggaactaaaacaagcaggtaggaagggtaatatcattccacttacagtatggaatgattgggccattattaaagcagctttagaaccatttcaaacagaagaagatagcgtttcagtttctgatgcccctggaagctgtataatagattgtaatgaaaacacaaggaaaaaatcccagaaagaaacggaaagtttacattgcgaatatgtagcagagccggtaatggctcagtcaacgcaaaatgttgactataatcaattacaggaggtgatatatcctgaaacgttaaaattagaaggaaaagttccagaattagtggggccatcagagtctaaaccacgaggcacaagtcgtcttccagcaggtcaggtgcccgtaacattacaacctcaaacgcaggttaaagaaaataagacccaaccgccagtagcctatcaatactggccgccggctgaacttcagtatcggccacccctagaaagtcagtatggatatccaggaatgcccccagcaccacagggcagggcgccataccctcagccgcccactaggagacttaatcctacggcaccacctagtagacggggtagtgaattacatgaaattattgataaatcaagaaaggaaggagatactgaggcatggcaattcccagtaacgttagaaccgatgccacctggagaaggagcccaagagggagagcctcccacagttgaggccagatacaagtctttttcgataaaaatgctaaaagatatgaaagagggagtaaaacagtatggacccaactccccttatatgaggacattattagattccattgctcatggacatagactcattccttatgattgggagattctggcaaaatcgtctctctcaccctctcaatttttacaatttaagacttggtggattgatggggtacaagaacaggtccgaagaaatagggctgccaatcctccagttaacatagatgcagatcaactattaggaataggtcaaaattggagtactattagtcaacaagcattaatgcaaaatgaggccattgagcaagttagagctatctgccttagagcctgggaaaaaatccaagacccaggaagtacctgcccctcatttaatacagtaagacaaggttcaaaagagccctatcctgattttgtggcaaggctccaagatgttgctcaaaagtcaattgccattgaaaaagcccgtaaggtcatagtggagttgatggcatatgaaaaccccaatcctgagtgtcaatcagccattaagccattaaaaggaaaggttcctgcaggatcagatgtaatctcagaatatgtaaaagcctgtgatggaatgggaggagctatgcataaagctatgcttatggctcaagcaataacaggagttgttttaggaggacaagtcagaacatttggaggaaaatgttacaattgtggtcaaattggtcacttaaaaaagaattgcccagtcttaaacaaacagaatataactattcaagcaactacaacaggtagagagccacctgacttatgtccaagatgtaaaaaaggaaaacattgggctagtcaatgtcgttctaaatttgataaaaatgggcaaccattgtcgggaaacgagcaaaggggccagcctcaggccccacaacaaactggggcattcccaattcagccatttgttcctcatggttttcagggacaacaacccccactgtcccaagtgtttcagggaataagccagttaccacaatacaacaattgtcccccgccacaagcggcagtgcagcagtagatttatgtactatacaagcagtctctctgcttccaggggagcccccacaaaaaatccccacaggggtatatggccccctgcctgaggggactgtaggactaatcttgggaagatcaagtctaaatctaaaaggagttcaaattcatactggtgtggttgattcaggctataaaggcgaaattcagttggttattagctcttcaattccttggagtgccagtccaggagacaggattgctcaattattactcctgccatatattaaagggtggaaatagtgaaataaaaagaataggagggcttggaagcactgatccaacaggaaaggctgcatattgggcaagtcaggtctcagagaacagacctgtgtgtaaggccattattcaaggaaaacagtttgaagggttggtagacactggagcagatgtctctatcattgctttaaatcagtggccaaaaaattggcctaaacaaaaggctgttacaggacttgtcggcataggcacagcctcagaagtgtatcaaagtactgagattttacattgcttagggccagataatcaagaaagtactgttcagccaatgattacttcaattcctcttaatctgtggggtcgagatttattacaacaatggggtgcggaaatcaccatgcctgctccattatatagccccacgagtcaaaaaatcatgaccaagatgggatatataccaggaaagggactagggaaaaatgaagatggcattaaaattccagttgaggctaaaataaatcaaaaaagagaaggaatagggtatcctttttaggggtggccactgtagagcctcctaaacccataccattaacttggaaaacagaaaaaccagtgtgggtaaatcagtggccgctaccaaaacaaaaactggaggctttacatttattagcaaatgaacagttagaaaagggtcatattgagccttcattctcaccttggaattctcctgtgtttgtaattcagaagaaatcaggcaaatggcgtatgttaactgacttaagggccgtaaatgccgtaaacgccgtaattcaacccatggggcctctccaacccgggttgccctctctggccatgatcccaaaagattggcctttaattataattgatctaaaggattgcttttttaccatccctctggcagagcaggattgtgaaaaatttgcctttactataccagccataaataataaagagccagccaccaggtttcagtggaaagtgttacctcagggaatgcttaatagtccaactatttgtcagacttttgtaggtcgagctcttcaaccagttagagaaaagttttcagactgttatatcattcattatattgatgatattttatgtgctgcagaaacgaaagataaattaattgactgttatacatttctgcaagcagaggttgccaacgcaggactggcaatagcatctgataagatccaaacctctactccttttcattatttagggatgcagatagaaaatagaaaaattaagccaccaaaaatagaaataagaaaagacacattaaaaacactaaatgattttcaaaaattgctgggagatattaattggattcggccaactctaggcattcctacttatgccatgtcaaatttgttctctatcttaagaggagactcagacttaaatagtaaaagaatgttaaccccagaggcaacaaaagaaattaaattagtggaagaaaaaattcagtcagcgcaaataaatagaatagatcccttagccacactccaacttttgatttttgccactgcacattctccaacaggcatcattattcaaaatactgatcttgtggagtggtcattccttcctcacagtacagttaagacttttacattgtacttggatcaaatggctacattaattggtcagacaagattacgaataataaaattatgtggaaatgacccagacaaaatagttgtccctttaaccaaggaacaagttagacaagcctttatcaattctggtgcatggcagattggtcttgctaattttgtgggaattattgataatcattacccaaaaacaaagatcttccagttcttaaaaatgactacttggattctacctaaaattaccagacgtgaacctttagaaaatgctctaacagtatttactgatggttccagcaatggaaaagcagcttacacagggccgaaagaacgagtaatcaaaactcaatatcaatcggctcaaagagcagaattggttgcagtcattacagtgttgcaagattttgaccaacctatcaatattatatcagattctgcatatgtagtacaagctacaagggatgttgagacagctctaattaaatatagcatggatgatcagttaaaccagctattcaatttattacaacaaactgtaagaaaaagaaattttccggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaagaaaaagaaattttccattttatattactcatattcgagcacacactaatttaccagggcctttgactaaagcaaatgaacaagctgacttactggtatcatctgcactcataaaagcacaagaacttcatgctttgactcatgtaaatgtagcaggattaaaaaacaaatttgatgtcacatggaaacaggcaaaagatattgtacaacattgcacccagtgtcaagtcttacacctgcccactcaagaggcaggagttaatcccagaggtctgtgtcctaatgcattatggcaaatggatgtcacgcatgtatcttcatttggaagattatcatatattcatgtaacagttgatacttattcacatttcatatgggcaacttgccaaacaggagaaagtacttcccatgttaaaaaacatttattgtcttgttttgctgtaatgggagttccagaaaaaatcaaaactgacaatggaccaggatattgtagtaaagctttccaaaaattcttaagtcagtggaaaatttcacatacaacaggaattccttataattcccaaggacaggccatagttgaaagaacaaatagaacactcaaaactcaattagttaaacaaaaagaagggggagacagtaaggagtgtaccactcctcagatgcaacttaatctagcactctatactttaaattttttaaacatttatagaaatcagactactacttctgcagaacaacatcttactggtaaaaagaacagcccacatgaaggaaaactaatttggtggaaagataataaaaataagacatgggaaatagggaaggtgataacgtgggggagaggttttgcttgtgtttcaccaggagaaaatcagcttcctgtttggatacccactagacatttgaagttctacaatgaacccatcggagatgcaaagaaaagcacctccgcggagacggagacaccgcaatcgagcaccgttgactcacaagatgaacaaaatggtgacgtcagaagaacagatgaagttgccatccaccaagaaagcagagccgccgacttgggcacaactaaagaagctgacgcagttagctacaaaatatctagagaacacaaaggtgacacaaaccccagagagtatgctgcttgcagccttgatgattgtatcaatggtggtaagtctccctatgcctgcaggagcagctgcagctaactatacctactgggcctatgtgcctttcccgcccttaattcgggcagtcacatggatggataatcctatagaagtatatgttaatgatagtgtatgggtacctggccccacagatgatcactgccctgccaaacctgaggaagaagggatgatgataaatatttccattgggtatcgttatcctcctatttgcctagggagagcaccaggatgtttaatgcctgcagtccaaaattggttggtagaagtacctactgtcagtcccatcagtagattcacttatcacatggtaagcgggatgtcactcaggccacgggtaaattatttacaagacttttcttatcaaagatcatttaaatttagacctaaagggaaaccttgccccaaggaaattcccaaagaatcaaaaaatacagaagttttagtttgggaagaatgtgtggccaatagtgcggtgatattacaaaacaatgaatttggaactattatagattgggcacctcgaggtcaattctaccacaattgctcaggacaaactcagtcgtgtccaagtgcacaagtgagtccagctgttgatagcgacttaacagaaagtttagacaaacataagcataaaaaattgcagtctttctacccttgggaatggggagaaaaaggaatctctaccccaagaccaaaaataataagtcctgtttctggtcctgaacatccagaattatggaggcttactgtggcctcacaccacattagaatttggtctggaaatcaaactttagaaacaagagatcgtaagccattttatactgtcgacctaaattccagtctaacagttcctttacaaagttgcataaagcccccttatatgctagttgtaggaaatatagttattaaaccagactcccagactataacctgtgaaaattgtagattgcttacttgcattgattcaacttttaattggcaacaccgtattctgctggtgagagcaagagagggcgtgtggatccctgtgtccatggaccgaccgtgggaggcctcaccatccatccatactttgactgaagtattaaaaggtgttttaaatagatccaaaagattcatttttactttaatagcagtgattatgggattaattgcagtcacagctacggctgctgtagcaggagttgcattgcactcttctgttcagtcagtaaactttgttaatgattggcaaaaaaattctacaagattgtggaattcacaatctagtattgatcaaaaattggcaaatcaaattaatgatcttagacaaactgtcatttggatgggagacaggctcatgagcttagaacatcgtttccagttacaatgtgactggaatacgtcagatttttctattacaccccaaatttataatgagtctgagcatcactgggacatggttagacgccatctacagggaagagaagataatctcactttagacatttccaaattaaaagaacaaattttcgaagcatcaaaagcccatttaaatttggtgccaggaactgaggcaattgcaggagttgctgatggcctcgcaaatcttaaccctgtcacttgggttaagaccattggaagtactacgattataaatctcatattaatccttgtgtgcctgttttgtctgttgttagtctgcaggtgtacccaacagctccgaagagacagcgaccatcgagaacgggccatgatgacgatggcggttttgtcgaaaagaaaagggggaaatgtggggaaaagcaagagagatcagattgttactgtgtctgtgtagaaagaagtagacataggagactccattttgttatgtactaagaaaaattcttctgcgttatgtactaagaaaaattcttctgccttgagattctgttaatctgtgaccttacccccaaccccgtgctctctgaaacatgtgctgtgtcaactcagagttaaatggattaagggcggtgcaagatgtgctttgttaaacagatgcttgaaggcagcatgctccttaagagtcatcaccactccctaatctcaagtacccagggacacaaaaactggggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtaaaagaggaaggaatgcctcttgcagttgagacaagaggaaggcatctgtctcctgcctgtccctgggcaatggaatgtctaggtataaaatccgattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctcttcgagaaacacccacaaatgatgaataaatactaagggaactcagaggctggcgggatcctccatatgctgaacgctggttccccgggtccccttatttctttctctatactttgtctctgtgtctttttcttttccaaatctctcgtcccaccttacgagaaacacccacaggtgtgtaggggcaacccacccctaca

SEQ ID NO: 121 - DNA, 5789 bp, Homo sapiens
gcctgaagcaatcgcgtcccctgtgacttgcacgtatacgcccagatggcctgaagtaacttaagaatcacaaaagaagtgaatatgccctgccccaccttaactgatgacattccaccacaaaagaagtgtaaatgaccggtccttgccttaagtgatgacattaccttgtgaaagtccttttcctggctcatcctggctcaaaaagcaccccgactgagcaccttgcgacccccactcctgcctgccagagaacaaaccccctttgactgtaattttcctttacctacccaaatcctataaaacggccccacccctatctccattcgctgactctcttttcggactcagcccgcctgcacccaggtgaaataaacagccatgttgctcacacaaagcctgtttggtggtctcttcacacggacgcgcatgaaatttggtgccgtgacttggatcaggggacttcccctaggagatcaatcccccgtcctcctgctctttgctccttgagaaagatccacctacgacctcaggtcctcagacccaccagcccaagaaacatctcaccagtttcaaatccggtaagcggcatctttttactctcttctccaacctccctcactatccctcaatctctttctcctttcaatcttggcaccacacttcaatctctcccttctcttaatttcaattcctttcattttctggtagagacaaaggagacacgttttatccgtggacccaaaactccggcgccggtcacggactgggaaggcagccttcccttggtgtttaatcactgcagggacacctctctgattatacgcccacgtttcaagggtgtcagaccacacaaggacgcctgccttggtccttcacccttaggggcaagtcccgcttttctggggaaggggcaaataccccaaccccttctctccttgtctctaccccttctctgcttttccagggacagggcaagtaaccgaaccccttgtcttcttgtctctaccccttctctgcttttctgggagggggcaagtacccctcaaccccttctccttcactcttaccaagtcccacttttctagaggagggacaagtaccccaacctcatatctctgcaccccaatcccttatttccacgccccaacctcttatatctctgtgccccaatcccttatttccgcgccccaacctcgtatctctgtgccccaatcccttatttccgtgccccgacctcttatttctgcgccccatcccttatttccatgccctgacctcttatctctgtgccccaaccccttttcccacttttctggaaggtaagaacccccgaaccccttccctctgtttctctactctctcttttctctaggcttgcttccttcactatgggaaccttccaccctccattcctccttctactcccctggcctgtgttctcaaaaacttaaaacctcttcaactcacacctgacctaaaacctaaatgccttattttcttctgcaatgccgcttgaccccaatacaaactcgacagtagttccaaatagccagaaaatggcactttgaatttttccatcctgcaatatctaaataattcttgtcgtaaaataggcaaacggtctgaggtgcctgatgtccaggcattcttttacacatcagtcccttcctagtctctgtgcccagtgcaactcatcccaaatcttccttctttccctcccatctgtcccctcagtactaaccccaagcatcgctgagtctttgttatcttccttttctacagacccacctgacctctcccttgctccccaggctgctcctcgccaggctgagctaggtcccaattcttcctccgcctctgctcctccaccctataatctttttatcacctcccctcctcacacctggtctggcttacagtttcgttccgtgactagccctccccgtcctgcccagcaatttactcttaaaaaggtggctggtgctaaaggcatagtcaaggttaatgctcctttttctttatcccaaatcagaagcgtttaggctctttctcatcaaatataaaaatccagcccagttcatgactcgtttgacagcaaccctgagacactttacagccctagaccctaaaaggtcaaaaggtcgtcttattctcaaaatacattttattacccaatctgctcccgacattaaataaaactccaaaaattaaattctggccctcaaaccccacaacaggatttaattaacctcgccttcaaggtgtgcaataatagaaaaaagttacaattccttccctccactatgagacaaaccccagccacatctccagcacacaagaacttccaaacgcctgaaccgcagtggccagaccttcctccagaacctcctcccccaggagcttgctacaagtgccagaaatctgaccaccaggccaaggaatgtctgcagcccaggattcctcctaagtcatgtcccatttgtgccagaccccactggaaatcggactgttcaacttacctggcagccactcccagagcccctggaactctggcccaaggctctctgactgactcctcctcggcttagcagctgaagactgacgctgcccgattgcctcggcagccccctagaccatcacggacgccgagcttcaggtaactctcacagtggaaggtaagcccatccccttcttaatcaatacggaggctacccgctccacattaccttcttttcaagggcctgtttcccttgcctccagaactgttgtgggtattgacggccaggcttctaaacctcttaaaactccccaactctggtgccagctgagacaatactcttataagcactcctttttagttatccccacctgcccagttcccttattaggctgagacactttaactaaattatctgcttccctgactattcctggactacagctatatctcattgccgcccttcttcccaatcaagagcctcctttgcgtcctcctcttgtatccccccaccttaacccacaagtataagatacctctactccctccttggcgaccgatcatgcaccccttaccatctcattaaaacctaatcacccttaccccactcaacgccaatatcccatcccgaagcacactttaaaaagattaaagcctgttatcactcgcctgctacagcatggccttttaaaatctataaactctacttacaattcccccattttaccagtcctaaaaccagacaagccttacaagttagttcaggatctgcgccttatcaaccaaattgttttgcctgtccaccccgtggtgccaaacccatatactctcctatcctcaatacctgcctctacaacccattattctgttctggatctcaaacatgctttctttactattcctttgcacccttaatcccagcctctcttcgctttcacttggactgaccctgacacccatcaagctcagcaaattacctaggctgtactgcctgccgcaaagcttcacagacagcccccattacttcaatcaagcccaaatttcttcctcatctgttacctatcttggcataattctcataaaaacacacgtgctctccctgccaatcgtgtccaactgatctctcaaacccaagcaccttctacaaaacaacaactcctttccttcctgggcatggttagcgcggtcagaattcttacacaagaaccaggaccacaccctgtagcctttctgtccaaacaacttgaccttactgttttagcccagccctcatgtctgcgtgcagcggctgccactgctttaatacttttaaaggccctcaaaatcacaaactgtgctcaactcactctctacagttctcataacttccaaaatctattttcttcctcatacctgacgcatatactttctgcttcccggctccttcagctgtactcactctttgttaagtcccacaattactgttgttcctgacccagacttcaatccggcctcccacattattcctgataccacacctgacccccatgactgtatctctgtgatccacctgacattcaccccatttccccaaatttccttctttcctgttcctcaccctgatcacacttgatttattgatggtggttccaccaggcctaattgccacacaccagcaaaggcaggttatgctatagtacaagccactagcctgcctcttagaacctctcatttcctttccctcgtggaaatctatcctcaaggaaataacttctcagtgttccatctgctattctactactcctcagggattattcaggccccctcctttccctacacatcaagctcgaggatttgcccccacccaggactggcaaatcagctttactcaacatgccccgagtcagaaaactaaaatacctcttagtctaggtagatactttcactggataggtacaggcctttcctacagggtctgagaaggccaccgcagtcatttcttccattctgtcagacataattcctcagtttagccttcccacctcaatacagtctgataacagatgagcctttattagtcaaatcagccaagcagtttttcaggctcttagtattcagcgaaacctttatatcccttacgatcctccatcttcaagaaaagtagaatggactaaaggtcttttaaaaacacacctcaccaagctcagccaccaacttaaaaaggactggacaatacttttcccttctcagaattcaggcctgtcctcagaatgctacagggtacagcccatttaagctcctttatagacgctccttttattaggccccagtctcattccagacaccagaccaacttagactgtgccccaaaaaacttgtcatccccactatcttctgtctagtcatactcctattcaccgttctcaactactcatacatgccctgctcttgtttacactgccggtttacactgtttttccaagccatcacagctgatatctcctggggctatccccaaactgccactcttaactcttgaagtaaataaataatctttgctggcaggactatgctgaatctccttaggcactctctaatcagatgtcctgagtcgtcccaattcttagaccttttatacctgtttttctccttctgttattctatttagtttctcaattcatccaaaaccgtatccaggccatgaccaatcattctatacgacaaatgtttcttctaacatccccacaatatcaccccttacacaagacttcccttcagcttaatctctccctctctacattcccacaccacccctaatcccgcttgaagcagccctgagaaacatcgcccattctctctccataccatccccccaaaaattttcgctgccccaacacttcaacactattttgttttatttttcttattaatataagaagacaggaatgtcaggcctctgagcccaagccaagccatcgcatcccctgtgacttgcacatatacgcccagatggcctgaagtaactgaagaatcacaaaagaagtgaatatgccctgccccgccttaactgatgacattccaccacaaaagaagtgtaaatggccggtccttgccttaagtgatgacattaccttgtgaaagtccttttcctggctcatcctggctcaaaaaacacccccactgagcaccttgcgacccccactcctgcccgccagagaacaaacccgctttgactgcaattttcctttacctacccaaatcctataaaactgccccacccctatctcccttcgctgactcttttcggatt

SEQ ID NO: 122 - DNA, 492 bp, Homo sapiens
ctacagtaggtagctggtcaggtaggagcactgcaggagagggctccctcctacacataccaggactgtcaggccaccatcaggtgatggtcaggcggttgctacagtgtctctctaaagtaataattggtcacagctggcgtcaggagaaggtgtgctcctaattgatagaaaatatctgaaactggtgatcagcagcttcctgataagatctcaggagtgggaagaagtaacgcaagtaacacatccttccgggtaacatcctggaagtatgccaatgtagaaaaccccaaggcaagaggtcaagccgtgcacttggtcgctcaagtggcctgcctggccctctttcaagtgtactttccttcctttcattcctgctctaaagcttttaaataaactttcactcctgctctaaaacttgccttgggtctctccttctgccttttgaccatcagtcgaattctttcttccgaggagacaagaattgaattg

SEQ ID NO: 123 - DNA, 3575 bp, Homo sapiens
gtcaggcctctgagcccaagccaagccatcgcatcccctgtgacttgcacgtatatacgcccagatggcctgaagtaactgaagaatcacaaaagaagtgaatatgccctgccccaccttaactgatgacattccaccacaaaagaagtgtaaatggccggtccttgccttaagtgatgacattaccttgtgaaagtccttttcccggctcatcctggctcaaaaagcacccccactgagcaccttgtgacccccactcctgcccaccagagaacaaaccccctttgactgtaattttcctttacgtacccaaatcctataaaacggccccacctttatctgccttccctgactgtcttttcggactcagcccgcctgcacccaggtgaaataaacagccacgttgctcacacaaagcctgtttggtggtctcttcacacggacgcgcatgaaatttggtgccgtgactcggatcgggggacctcccttgggagatcaatcccctgtcctcctgctctttgctctgtgagaaagatccacctatgacctcaggtcctcagaccgaccagcccaagaaacatcgcaccaatttcaaatccggtaagcggcctctttttcctctcttctccaacttccctcactatccctcaacctctttctcctttcaatcttggcgctacacttcaatctctcccttctcttaatttcaattcctttcattttctggtagagacaaaggagacacgttttatccgtggacccaaaactccggcgcgggtcacggactgggaaggcagccttcccttggtgtttaatcattgcagggacgctctctgattatacacccacgtttcaagggtgtcagaccacgcagggacgcctgccttggtccttcaccattagcggcaagtcccgcttttctggggaaggggcaagtaccccaaccccttctctccttgtctctaccccttctctgcttttctgggagaggggcaagtacccctcaaccccttctccttcacccttagcagcaagtcccgcttttctacggggcaagaacccccaatcccttatttccgcaccccaacctcttatctctgcaccccaatcccttccgagccccaacctcgtatctctgcaccccaatcccttatttccacgccccgacctcttatctctgtgccccaacccctttgcccacttttctagaaggtaagaacccccgaaccccttccctccgtttctctactttctcttttctctaggcttgcttccttcactgtgggcaaacttccaccctccattcctccttcgactcccttggcctgtgttctcaaaaacttaaaacctcttcaactcacacctgacctaaaacctaaatgccttattttcttctgcattgccgcttgaccccaatacaaactcgacagtagttccaaatagccagaaaatggcactttgaatttttccatcctgcaagatctaaataattcttgtcgtaaaataggcaaacggtctgaggtgcctgacgtccaggcattcttttacacatcagtcccttcctagtctctgtgcccagtgcaactcatcccaaatcttccttctttccctcccgcctgtccccttagtaccaaccccaagtgtcactgagtctttctaatcttccttttctacagacccatctgacctctcccttcctccccaggctgctcctcgccaggccgagctaggtcccaattcttcctcagcctccgctcctccaccctgtaatctttttatcacctcccctcctcacacctggtccggtttacagtttcgttctgtgactagccctcccccacctgcccagcaatttactcttaaaaaggtggctggagctaaaggcatagtcaaggttcatgctcctttttctttatcccaaatcagatagcgtttaggctcttttttatcaaatataaaaatccagcccagttcatgacttgtttggcagcaaccctgagacactttacagccctagaccctgaaaggtcaaaaggccgtgttattctcaaaatacattttattacccaatctgctcccgacattaaataaaactccaaaaattggaatctggccctcaagccccacaacaggacttaattaacctcacctttaaggtgtacaataatataaaaaagttgcaattccttgcctccactgtgagacaaaccccagccacatctccagcacacaagaacttccaaatacctgaaccacagcagccaggcgttcctccagaacctcttcccccaggagcttgctacaagtgctggaaatctggccactgcgccaaggaatgcctgcagcccaggattcctcctaagccatgtcccatctgtgcgggaccccactggaaattggactgttcaactcacctggcagccactcccagagcccctggaactctggcccaaggctctctgactgactccttctcggcttagcggctgaagactgatgctgcccgatcgcctcagaaggcccgtagaccatcacggacgcccaacttcgagtaactctcacagtggagggtaagtccatccccttcttaatcaatatggaggctacccactccacattaccttcttttcaagggcctgtttcccttgcctccataactgttgtaggtattgacagccaggcttctaaacctcttaaaactccccaactctggtgccaacttagacaatactcttttaagcactcctttttagttatccccacctgcccagttcccttattaggctgagatactttaactaaattatctgcttccctgactattcctggattacagctatatctcattgccgcccttcttcccaatccaaagcttcctttgcttcctcctcttgtatccctccaccttgacccacaagtataagatacctctactccctccttggcgaccgatcatgcaccccttaccatctcattaaaacctaatcacccttactccactcaacaccaatatcccatcccgcagcacgctttaaaaagattaaagcctgttatcactcacctgttacagcatggccttttaaagcctataaactctccttacaattccctcattttacctgtcctaaaaccagacaagccttataagttagtttagttcaggatctgtgccttatcaatcaaccaacttgttttgcctatccaccccgtggtgccaaacccatatactctcctattctcaatacctgcctctacaacccattattctgttctagatctcaaacgtgctttctttactattcctttgcacccttaatcccagcctctcttcgctttcacttggactgaccctgacacccatcaagctcagcaaattacctgggctgtactgccgcaaggcttcacagacagcccccattacttcagtcaagcccaaatttcttcctcatctgttacctatctctgcataattctcataaaaacacacgtgctctccctgccaattgtgtccaactgatctctcaaaccccagcaccttctacaaaacaactcctttccttcctaggcatgattag

SEQ ID NO: 124 - DNA, 6441 bp, Homo sapiens
gtcaggcctctgagcccaagccaagccatcacatcccctgtgacttgcacgtatatgcccagatggcctgaagtaactgaagaatcacaaaagaagtgaatatgccctgccccaccttaactgatgacattccactacaaaagaagtgtaaatggccggtccttgccttaagtgatgacattaccttgtgaaagtccttttcctgggtcatcctggctcaaaaagcacccccactgagcaccttgcgacccccactcctgcccgccagagaacaaaccccctttgactgtaattttcctttacctacccaaatcctataaaatggccccacccttatctccctttgctgactctcttttggactcagcccgcctgcacccaggtgaaataaacagccatgttgctcacacaaagcctgtttggtggtctcttcacacggacgcacatgaaatttggtgccgtgactctgatcaggggacctcccttgggagatcaatcccctgtactcgtgttcttcgctccattagaaagatccacctatgacctcaagtcctcagaccgaccagcccaaggaacatctcaccaattttaaatcaggcaagtggcctcttcttactctcttctccaacctctctcactgtccctcaaccactttctcctttccactcttcaatctctcccttctcttaatttcaattcctttcattttctgggagagacaaaggagacacattttatccgtggacccaaaactccggcgccggtcatggactgggaaggcaggcttcccttggtgtttaatcattgcagggacgcctctctgattatacacccacgtttcaagggtgtcagaccacacagggatgcctgccttggtccttcacccttagcggcaagtcccgcttttctggggaaggggcaagtaccccaaccccttctctccttgtctctaacccttctctgcttttctgggagaggggcaagtacccctcaaccgcttctccttcacccttagcggcaagtcccacttttctatggggcaagaacccccaatcccttatttccacaccccagcctcttatctctgtaccccaatcccttatttccgcaccccaacctcttatctctgccccaatcccttatttccacaccccgacctcttatctctgcaccccaatcccttatttcctcaccccgacctcttatctctgcaccccaatcccttatttccgtgccccaacctcttatatctctgcaccctagtcccttatttccacgccccgacctcttatctctgagccccaacccctgttcccacttttctggaaggtaagaacccctgaaccccttccctccatttctctactctcttctctaggcttgcttccttcactatgggcagccttccaacctccattcctccttctactcccttggcctgtgttctcaaaaacttaaaacctcttcaactcaccacctgacttaaaacctaaatgccttattttcttctgcaatgccgcttgaccccaatacaaactcgacagtagttccaaatagccagaaaatggcactttgaatttttccatcctgcaaaatctaaataattcttgttgtaaaataggcaaatggtctgaggtgcctgacgtccaggcattcttttacacatcagtcccttcctagtctctgtgcccagtgcaactcgtcccaaaccttccttctttccctcccgcctgtcccctcagtaccaaccacaagcgtcgttgagtctttctaatcttccttttctacagacccatctgacctctcctttcctccccaggctgttcctcaccaggctgagctaggtcccaattcttcctcagcctcttctcctccgccctataatctttttatcacttcccctcctcacacctggtcgggcttacagtttctttccgtgactagccctccccaacctgcccagcaatttactcttaaaaaggtggctggagctaacggcatagtcaaggttaatgctcctttttctttatcccaaatcagaagcatttaggctctttttcatcaaatataaaaatccagcccagttcatggctcgtttggcagcaacctgagatgctttacagccctagaccctaaaaggtcaaaaggctgtcttattctcaatatacattttattacccaatctgctcccgacattaaataaaactccaaaaattggaatctggccctcaaaccccacaacaggacttaattaacctcaccttcaaggtgtacaataacagaaaaaagttgcaattccttgcctcctctgtgagacaaaccccagccacatctccagcacacaagaacttccaaacgcctgaaccgcagcagccaggcattcctccagaacctcctcccccaggagcttgctacaagtgctggaaatctggccactgggccaaggaatgcccgcagcctgggattcctcctaagccacgtcccatctgtgtgggaccccactgaaaattggactgttcaactcacctggcagccactcccagatcccctggaactctgtcccaaggctctctgactgactccttcccagatcttctcggcttagcggctgaagacagacactgcccgatcgcctaggaagccccttagaccaacacggacgccgagcttcgggtaactctcacagtggaaggtaagcccatccccttcttaatcaatatggaggctacccactccacattaccttcttttcaagggcctgtttcccttgcctccataactgttgtgggtattgatggtcaggcttctaaacctcttaaaactccccaactctggtgccaacttagacaatactcttttaagcactcctttttagttatccccacctgcccagttcccttattaggctgagacactttaactaaattatctgcttccctgactattcctggactacagctatatctcattgccgcccttcttcccaatccaaagcctcctttgcgtcctcctcttgtatccccccaccttaacccacaaatataagatacctctactccctccttggtgaccgatcatgcatcccttaccatcttattaaaacctaatcacccttaccctactcaacgccaatatcccgtcccgcaacacgctttaaaaagattaaagcctgttatcactcacctgctatagcatggccttttaaagcctataaactctccttacaattcccccatttttacctgtcctaaaaccagacaagccttacaagttagttcaggatcttcgccttatcaaccaaattgttttgcctatccaccctgtggtgcccaacccagtacactcttttgtcctcaataacttcctccacaactcactattccatgcttgatcttaaagatgcttttttcactattcccctgcaccccttgtcccagcctctctttgctttcacttagactgaccctgacacccattaggctcagcaaattacctaggctgtactgccgcaaggcttcatagacagcccccattacttcagtcaagcccaaatttcatcctcatctgttacctatctcggcataattctcataaaaacgtacgtgctttccctgctgatcgtgtccgattaatctcccaaacctcaatcccttacaaaacaacaactcatttccttcctaggcatagtgtggtcagaattcttacacaagagccaggactgcaccctgtagcctttctgtgcaaacaacttgaccttactgttttagcctagccctcatgtctgtgtgcagtggctgccactgctttaatacttttaggggccctcaaaatcacaaactatgctcaactcactctctacagttctcataacttccaaaatctattttcttcctcacacctgacgcatatactttctgctccccggctccttcagctgtactcactctttaagtcccacaattaccattgttcctggcccagacttcaatctggcctcccacattattcctgataccacacctgacccccatgactgtatctctctgatccacctgacattcaccccatttccccaaatttccttctttcctgttcctcaccctgatcacgcttaatttattgatggcggttccaccaggcctaatcgccacacaccagcaaaggcaggttatgctatagtacaagccactagcccgcctcttagaacctctcatttcctttccatcgtggaaatctatcctcaaggaaataacttctcagtgttccatctgctattctactactcctcagggattattcaggccgcctcccttccctacacatcaagctcgaggatttgccccacccaggactggcaaattagctttactcaacgtgacctgagtcagataactaaaatacctcttagtctaggtagatactttcactggataggtagaggcctttcctacagggtctgagaaggccaccgcagtcatttcttccgttctgtcagacataattcctcagtttagccttcccacctcaatacagtctgataacagatgagcctttattagtcaaatcagccaagcagtttttcaggctcttagtattcagtgaaaactttatatcccttacggtcctccgtcttcaagaaaaatagaatggactaaaggtcttttaaaaacacacctcaccaagctcagccaccaaaaaggactggacactacttttaccactttcccttctcagaattcaggcctgtcctcggaatgctacagggtacagcccatttaagctcctgtatagatgctcctttttattaggccccagtctcattgcagacaccagaccaacttagactgtgccccaaaaaacttgtcatccctactatcttctgtctagtcatactcctattcaccattctcaactactcataaatgccctgcttttgtttacactgccggtttacactgttttcccaagccaccacagctgatatctcctggtgctatcaccaaactgccactcttaactcttgaagtaaataaataatctttgctggcaggactatgctgaatctccttaggcactctctaatcagatatcctgagtcgtcccaattcttggaccttttatacctgtttttctccttctgttattccatttagtttctcaattcatccaaaaccatatccaggccatcaccaatcattctatacgacaaatgtttcttctaacatccccacaatatcaccccttaccacaagacctcccttcagcttaatctctcccactctaggttcccacgacgcccctaatcccacttgaagcagccctgagaaacatcgcccattctctctccataccaccccccaaaaattttcgccaccccaacacttcaacactattttgttttatttttcttattaatataagaaggcaggaatgtctatctgcttgaagtgaggagaacatatgttgttgaggaagagtaattatttttatacactatgtataataggtgtgcaattaatgtgaatgaatgaataaagaaatcaatgaatgaatggaatgagattatgtttgtagactgaatggaagaagccagtgaagaggaagagactgaaagtagaggaaaagatgagagaaataacagagcaagattcccaagtgagagtggcaaactcctgggcttgatctagaatgcttcttataccctacacagggtgagatcattattgtattagtggcttgatatgggacatctgcgtggggacagagtagatccatccatacagagataggagaaattgctcttatagaaaaaatgtagtaaaatatactcagtacaagggaaatatgtaaatttacatttgtatagaaagtatttcaagatataccaggacagaagccttcccttcatccccagtctcacttcctatagtctcacctgcaaggccctgatgagattgtccactcctatctgcacacgccatgaacattgtcaggcctctgagctcaagccaagctatcgcatcccctgtgacttgcacgtgtatgcccagatggcctgaagtaactgaagaatcacaaaagaagtgaatatgccctgccccaccttaactgatgacattccactacaaaagaagtgtaaatggccggtccttgccttaagtgatgacattaccttgtgaaagtccttttcctgggtcatcctggctcaaaaagcacccccactgagcaccttgcaaccccccactcctgcccgccagagaacaaaccccctttgactgtaattttcctttacctacccaaatcctataaaacggccccacccttatctcccttcgctgactctctttttgtactcagcccgcctgcacccaggtgaaataaacagccatgttgctcacacaaagcgtgtttggtggtctcttcacagggacgcgcatgaaa

SEQ ID NO: 125 - DNA, 785 bp, Homo sapiens
gagagacaggactagctggatttcctaggccgactaagaatcccgaagcctagctgggaaggtgactgcatccacctttaaacaacgggcttgcaacttagctcacacccgaccaatcagagagctcactaaaatgctaattaggcaaaaacaggaggtaaagaaatagccaatcatctattgcctgagagcacagtgggagggaaaaggatcgggatataaacccaggcattcgagccggcaacggcaaccccctttgggtcccctccctttgtatgggagctctgttttcactctgtttcactctattaaatcttgcaactgcactcttctggtccttgtttgttacggctcgagctgagctttcgctcgcagtccaccactgctgtttgccgccgtcgcagacccgccgctgacttccatccctccagatccggcagggtgtccgctgtgctcctgatccagcaaggcgcccattgccactcctgatcgagctaaaggcttgccattgttcctgcacggctaagtgcctgggttcatcctaatcgagctgaacactagtcactgggttccacggttctcttccgtgacccaccgcttctaatagagctattaacactcactgcatggcccaagattccattccttggaatctgtgaggccaagaaccctaggtcagagaacacgaggtttgccaccatcttggaagtggcccgccaccatcttggaagtggctcgccaccatcttgggagctctgtgagcaaggacccctgctgtaacagtt

SEQ ID NO: 126 - DNA, 85 bp, Homo sapiens
gaggttgaggatttgcttgtatttcaccaggagagaatcagcttcctgtctgggtacccacaagacatcttaagctgtgccatga

SEQ ID NO: 127 - DNA, 6461 bp, Homo sapiens
ggcaggcctctgagcctaagctaagccatcatatcccctgtgacctgcacttacacatctagatggccgattcctgccttaactgatgacattatcttgtgaaattccttctcctggctcataagctcccctactgggcaccttgtgacccccactcctgccagccagagaacccccgctttgactgtaattttcctttacctacccaaatcctataaaatggccccacccctatctccctttgctgactcttttcagactcaacccacctgcacccaggtgaaataaacagccttgttgctcacacaaagcctgtttggtggtctcttcacacagacaccaatgaaatttggtgccgtgactcggatcaggggacctcccttgggagatcaatcccctgtcctcctgctctttgatctgtgaaaaagatccacctacgaccttgggtcctcagaccgaccagcccaaggaacatctcaccaattttaaatcaggtaagcagcctcttcttactctcttctccaacctctctcactatccctcaaccattttctcctttcaatcttggcaccacctttcaatatctcccctctcttaatttcaattcctttcattttctggtagagacaaaggagacacgttttatctgtggacccaaaactccggcgccggtcacggactcaggaagccagccttcccttggtgtttaatcactgcagggacacctctctgattattcacccatgtttcagaggtgtctgaccacgtggggacacctgccttggtccttcacccttagcggcaagtcctgcttttctggagagcaagaaccccccaactccttctctccatgtctctaccccttctccgcctttctgggaggcaagaaccccccaaccccttctccttcacccttagcagcaagtactgcttttctagggggcaagaaccccccgatccctaatttccatgtcccgacctcttatctctgtgccccgatcccttatttccatgccccgacctcttatctctgtgccccatcccttatttccgtgtcccgacctcatatctctgtgccctaaccccttatttccgtgccctgacctcttatctctgccccaaccccttatttccatgctccaacccctttcccgcttttctggaaggtaagaacccccgaaccccttccctccatgtctctactctctcttttctctgggcttgccttcttcactataggcaacccctcaccctccattcccccttcttctcccttagcctgtgttcttaaaaacctacaacctcttcaactcacacctgacctaaaacctaaatgccttattttcttctacaatgccactggacccaaatacaaactcgacagtggttccaaatagccagaaaacagcactttcattttttccatcctacaagatctaaataattcttgtcgtaaaatacgcaaatagtctgaggtgcctgacgtccaggcattcttttacacatcagtccctccatagtctctgttcccaatacaactcgtcccaaatcttccttctttccctcccgcctgtcccctcagtcccaacctcaagtgttgctgagtctttctaatcttccttttctacagacgcatctgacctctccctccatcgccaggccaaactaggtcccaattcttcctcagcctccaatcctccaccctataatccttttatcacctcccctcctcacacccagtccagcttacagtttcattccatgactagccatcccccaccagcccagcaatttcctcctaaaaaagtggctagagataaaggcatagtcaagattaatgcttctttttctttatcccacatcagagagcatttaggttctttttcatcaaatataaaaacccagcccagttcatggctcatttggcagcaaccctgagacgctttacagccctagaccctaaaaggtcaaaaggccgtcttattctcaatatacactttattacccaatttgctcccaacattaaataaaactccaaaaattaaattccagccctcaaaccccaaaacaggacttaattaacctcaccttcaaggtgtacaataatacagtgaaggcagccaattgcaacgtatttctgagttgcaattctttgcctccactgtcagacaaaccccagccacatctccagtacacaagaacttccaaacgcctgaaccacagcagccaggcattcctccagaacctcctcccccaggagcttgctacaagtgccaaaaatctggccaccaggccaaggaatgcccgcagcctgggattcctcctaagccatttcccatctgtgtgggaccccactgaaaatcggactgttcaactcacctggcagccactcccagagcccgtggaacgctggtgcaaggctctttgactgactccttcccagatcttctcagcttaacggctgaagactgatgctgccgaattgcctcagaagcccctagaccatcacggacgctgagcttcaagtaactctcacagtggaaggtaagtccatccccttcttaatcggaggctacccactccacattaccttcttttcaaggacctgtttcccttgcctccataactgttgtgggtattgacggccaggcttctaaacctcttaaaactccccaactctggtgccaacttagacaatactctattaagcactcctttttagttatccccacctgcccagttcccttattaggccgagacacagtaactaaattatctgcttccgtgactattcctgggccacagccacacctcattgctgccttttcccccagttcaaagcctccttcacatcctcccctttgtctctccaccttaacccacaagtataagacacctctactccctccttagtgactgatcatgcaccccttaccatccctttgaaacctaatcactcttaccccgctcaatgccaatatcccatcccacagcacactttaaaaggattaaagcctattatcacttgcctgctacagcatggccttttaaagcctataaactctccttacaattcccccattttacctgtcctagaaccagacaagcgttacaggttagttcaggatctgagccttatccaccaaattgttttgcctatccaccccgtggtgccaaaatactctcctatcctcaatacctccctccacaacccattattctgttctagatctcaaacatgctttctttactattcctttgcacccttcatcccagcctctcttcgctttcacttgcactgaccctgacacccatcaggctcagcaaattacctaggctttactgccacaaagcttcacagacagcccccattacttcagtcaagcccaaatttcttcctcatctgttacctatctcagcgtaattctcataaaaacacacatgctctcccttgatcatgtccagctgatctctcaaacccccaacaccttctacaaaacaacaacttctttccttcctaggcatggttagatactttcgactttagatacctggttttgccatcctaacaaaaccattatataaactcagaaaaagaaacctagctgaccccatagatcctaaatcctttccccactcctctttccgttccttaaagacagctttaaagactgcccccacccttcctctccctgactcatcccaacccttttcattacccacagccgaagtgcagggctgtgcagtcagaattcttacacaaggaccaggatcacgtcctgtagcctttttgtccaaacaactttaccttactgttttaggctggccatcatgtctccgtgcagtggctgctgccgccctaatactttagaggctcttaaaatcacaagctatgctcaactcactctctacagttctcataacttccaaaatctgttttcttcctcacacctgacacatatactttctgcaacctggctccttcagctgtattcactctttgttaagtctcccacaattaccattgttcctggcacagacttcagtccggcctcccacattattctggataccacacctgaccctcacgactgtatctctctgatccacctgacattcaccccatttccacatatttccttcttttctgttcctcaccttgatcacatttagtttattgatggcagtttcaccaggcctaatcgccactcaccagcaaaggcaggctatgctatagtatcttccacatctatcattgaggctaccactctgcccccctccactatctctcagcaagctgaattagttgccctaactgaagccctcactcttgcaaaaagattacgtgtcaatatttatactgactctaaatatgcctttcatattctgcacaaccatgccgttatataggctgaaagaagtttcctcactatacaagggtcctccatcattaatgcctctttaataaaaaccctgctcaaggccgctttacttccaaaggaagctggagtcattcactgcaaaggccatcaaaaggcatcagatcccattgctctaggcaatgcttatgctgataaggtggctagacaagcagctagccttccaacttctgtccctcacggccagtttttctccttcacatcagtcactcccacctactcccccgctgaaacttccacctatcaatctcttcccacacaaggcaaatagttcttagaccaaggaaaatacctccttccagcctcacaggcccattctattctgtcgtcatttcataacctcttccatgtaggttaggagccactagcccatctcttagtacttctcatttcctttccatcctggaaatctgtcctcaaggaaatcacttctcagcgttccatttgctattctactaccccttagggattgttcaggcctcctccctttcctacacatcaagctcgaggatttgcccctgcccaggactggcgaattgactttactcgcatgccccgagtcagaaaactaaaatacctcttagtctaagtagacactttcattggataagtagaggcctttcctacagggtctaagaagcccaccgcagtcatttcttcccttctgtcagacaattcctcggtttggcttttccacctctatacagtccgatagcagaccggcctttattagtcaaatcagccaagcattttttcaggctcttggtattcagtgaaacctttatatcccttatggtcctcagtcttcaggaaaggtagaacggactaatagtcttttaaaaacacacatcaccaagctcagccaccaacttaaaaaggcctggacaatacttttaccagtttcccttctcagaattcaggcctatccttagaatgctacagggtacagcccatttaagctcctgtatagacgctcctttttattaagccccagtctcattccagacaccagaccaacttgggctgtgccccaaaaaacttgtcatctctactatcttctgtctagtcatactcccattcaccattctcaactactcatacatgccctgctcttgtttacactgctggtttacactgtttctccaagccatcgcagctgatatctcctgatgctatccccaaactgccactcttaactcttgaagtaaataaataatctttgctggcaggactatgctgaatctccttaggcactctctaattagatgtcctgggtcctcccaattcttagacctttaatacctgtttttctccttctcctattccatttagtttttcaattcatacaaaaccgtatccaggccatcaccaataattctaaatgacaaatgtttcttctaacagtcccacaatatcaccccttaccacaaaaccttccttcagcttaatctctcccactctagattcccacgccacccctaatcccgctcgaagcagccctgagaaacatcgcccattatgtctccataccacccccaaaaattttcaccgtcccaacactttaccactatttcattttatttttcttattaatataagaagacaggaatttcaggcctctgagcccaagctaagccattatatcccctgtgacctgcatgtacacatccagatggcaggttcctgccttaactgatgacataccaccacaaaagaaatgaaaatggcctgttcctgccttaactgatgacattatcttgtgaaattccttctcctggctcatcctggctcaaaagctcccctactgaacaccttgtgacccccactcctgccagccagagaacaaccccctttgatggtaattttcttttgcctacccaaatcctataaaattgccccacccctatctccctttgctgactctcttttcagactcagcccgcctacacccaggtgaaataaacagccttgttgctcacccaaagcctttttggtggtctcttcacacagacatgcatgaaa

SEQ ID NO: 128 - DNA, 5642 bp, Homo sapiens
gtcaggcctctgagcccaagctaagccgtcatatcccctgtgacctgcacgtatacatccagatggcctgaaataactgaagaatcacaaagaagtgaaaatggcctgttcctgccttaactgataacattaccttgtgaaattccttctcctggctcttctggctcaaaagctcccccactgagcaccttgtgacccccacccctgccagccaaaaaacaaccccctttgactgtaattttccattacctacccaaatcctataaaacagccccacccctatctccttttgctgactcttttcggattcagcctgcctgcacccaggtgattaaaaagctttattgctcacacaaagcctgtttggtggtctcttcacagggacacgcatgaaatttggtgccatgactcggatcaggggacctcccttgggagatcaatcccctgtcctcctgctctttgctcagtgagaaagatccacctatgacctcaggtcctcagaccaaccagcccaaggaacatcccaccaattttaaacccggtaagcagcctctttttactctcttctccaacctctctcactatctctcaacctctttctcctttcaatcttggcgccatctttcaatctctcccttcccttaatttcagttcctttccttttctggcagagacagaggagacgtgttttatccgtgaacccaaaactccagcgctggtcacagactcgggaagacagtcttcccttggtgtttaatcactgcggggatgcctgcttgattattcacccacatttcagaggtgtttgatcaccacggggacacctgccttgatccttcacccttagtggcaagcaccactaatttggggggcaagcacctcccttctctccgtgtctctaccctcccttttctctccactttcctggggggcaggcatcccccacaccttctctccatgtctctatcctctcttttctctgggcttacctccttcactatgggcaaacttccacccctccattcctccctcttctcccttagcctgtgttctcaagaatttaaaacctcttcaactcacacgtgacctaaaacctaaacatcttattttcttctgcaatgccacttaaccccaatacaaactcaacaatggttccaaatagccagaaaacggcactttcgatttctccatcctacaagatctagataattcttgtcataaaatgggcaaatggtctgaggtacctgacacccaggcattctttgttccctccctagtctatttccaatgcaattggtcccaaatcttcttttccctcccacctgtcccttcagtcccaaccccaagtgttgttgagtctttccaatcttccttttctaccgacccatctgacctctcccctcatccccagactgctcctcaggtcactccccagccaggctgaatcaggctccaattcttcctcagtttctgctcctccaccctataatccttctatcaccccctctccccaaacccagtccagcttacagtttcgttctgcaactagccctcccccatctgcccagtaatttcctcttaaaaaggtggctggagctaaaggcatagtcaaggttaatgctcctttttctttatccgaactctcccaaatcagttagtgtttaggctctttttcctcaaatataaaaacccagcccagttcatggctcatttggcagcaaccctgagacgctttacagccctagaccctgaagggtcagaaggctgtcttattctcaatatgcattttatcacccagtcagcccctgacattagaaaaaagcttcaaaaattagaatccggccctcaaacctcgcaatgggaattaatcaaccttgccttcaaggtgtacaataatagaaaggaggcagccagacagcaacacatttctgagttacaattacttgcctctgctgtgagacaaaacccagccgcatctccagcatacaagaacttcaaaacgcctgaactgcagcggccaggcattcctccaggaccacctgccccaggatcttgcttcaagtgctggaaatctggccactgggccaagtattgcctgcagcctgggattcctcctaagccatgtcccatctgtgcaggaccccactggaaactggactgtccaactcacccagcagccactcccagagcccctggaactctggcccaaggctatctgactgactccttcccagatcttctccgcttagcggctgaagactgatgctgcccaatcgcctcagaagcttcctggatcatcacagatgctttaggtaactcttacagtggagggtaagtccgtccccttcttaatcaatatggaggctaccaactccacattaccttcttttcaagggcctatttcctttgcctccacaactattgtgggtattgacagccaggcttctaaacctcttaaaacttcccaactctggtgccaacttggacaatattcttttatgcactcctttttagttatccccacctgcccagttcccttattaggtcaagacattttaactaaattatctgcttccctgactattcctgggctacagccacaccttattgccacccttttccccagtttaaagcctccttcacatcctccccttgtatctccccaccttaatccacacatatgggacatgtctactccctccttggtgactgatcatgcaccccttaccatcccattaaaacctaatcacccttaccctgttcaatgctaatatcctatcccacagcatgctttaaaaagattaaagcctgttatcacttgcctgttacagcatggccttttaaagcctataatctctccttataattcccccattttacctgttcaaaaaccagacaggtcttacaggttagtgcaggatctgtgccttatcaaccaaattgttttgcctatccaccccatggtgccaaactcatatatgctcctatcctccatacctccctccacaacccattattctgttctggatctcaaacatgctttctctactattcctttgcacccttcatcccagcctctcttcactttcacttggactgaccctgacacccatcaggctcagcaaattacctgggctgtactgctgcaagtcttcacggacaggccccattacttcagtgaaccccaatttcttcctcatccattacctatctcaacataattcttcatgaaaacacacatgctctccctgctgatcacgtccagctaatctcacaaaccctaaccccttctacaaagcaacaatgcctttccttcctaggcatggttagatactccacctttggatacctagttttaccatcctgactaaaccattatataaacttaaaaatgcaaacttagctgatcccatagatcctaaattctttcgccactcctctttctgttccttaaaaacagccctagaagctgctcccacactagctctctctaactcatccaaccctttttcattacacacagctgaagtgcagggctgtgcggtcagaattcttacacaagagccaggaccgcgcccggcagcctttctatccaaacaacttgaccttactgttttagcctagccctcatgtctgtgtacggcagctgtcgctgctttaatacttttagaggccctcaaaatcacaaactgtgctcaactcactctctccagttctcataacttccaaaatctattttcttcctcacacctgatgcatatactttctgccccgctccactacctctcagcaagctgaactcattgccttaactggagccctaacccttgcaaatgaattacacgtcaatatttatactgactctaaagatgccttccatatcctgcaccaccatgctgttgtatgggctgaaagaggtctcctcactacacaagggtcctccatcttaatgcctctttaataaaaactcttctcaaggccgctttacttccaaaggaagctggagtcattcactgcaagggccatcaaaaggcatcagatcccattgctctgggcaatgcttatgctgataaggtagctaaaaagcagctagcattccaacttctatccctcacagccagtttttctccttctcatcggtcactcccacctactcccctactaaaacttccacctatcaatctcttcccacacaaggcaaatggttcttagaccaaggaaaatatctccttccagcctcacaggcccattctattctgtcgtcatttcataacctcttccatgtaggttacaagccactagcccacctcttagaacctctcatttcctttccatcatggaaatctatccacaaggaaatcacttctcagggttccatctgctagtctactactcctcaggaccctcccttccctacacatcaagctcagggatttgcctctgcccaggactggcaaattgactttactcacatgccccaagtcaggaaactaaaatacctcttggtctaggtagacacgttcaccggttgggtagagacctttcccgtagggtctgaaaaggccaccacgatcatttcttcccttctgtcagacataattcctcggtttggccttcctacctctatacagtctgataacagaccagcctttattagtcaaatcactcaagcagtttctcaggctcttggtattcagtgaaaccttcataccccttaccgtcttcaatcttcaggaaaggtaaaacggactaatggtcttttaaaaacacacctcaccaaactcagcctccaacttaaaaaaaggactctgtcaagaatagagcccaaaaactcaccaaccaaacaagtaattacactgaatccccttgggcactctctaatcggatgtcctgggtcctcccaattcttagtcctttaatacctgtttttctccttctcttattcagaccttgtgtcttccatttagtttttcagttcatacaaaattgcatccaggccatcaccaatcattctacatgacaaatgctccttttaacaaccccacaatatcaccccttaccacaaaatcttcctttggcttaatctctcccactctaggttcccacactgcccttaatcctgcttgaagcagccctgagaaacattgcccattatctctccataccacccccaaaatttttgctgccccaacacttcaacactattttatgttatttttcttactaatataagaagacaggaatatcaggcctctgagcccaagctaagccatcatgtcccctgtgacctgcacgtatgcacccagatggcctgaagtaactgaaggatcacaaaagaagtgaaaacggcctgttcctgccttaactgatgacattaccttgtgaaattccttctcctggctcatcctggctcaaaagctcccccactgagcaccttgtgtcccctgcccgtgcctgccaaagaacaacccctttgactgtaattttccatgacctacccaaatcctataaaacggccccacccctatctcccttcgctgactctctttacggacttagcccacctgcacccaggtgattaaaaagctttattgctcacacaaagcctgttcagtggtctcttcacagggacacgcgtgaaa

SEQ ID NO: 129 - DNA, 764 bp, Homo sapiens
gagaggcaggactagctggatttcctaggccgactaagaattcttaagcctagctggggaaggtgactgcatctgcctttaaacacagggcttgtaactcagctcatacccaaccaatcaggtagtaaagagggctcactaaaatacaaattattctaaagcaggaggtaaagaaatagtcaaatcgtatattgcctgagagcacagtgggagggacaatgattgggatataaacccaggcattagagcagggagcggcaaccccctttgggtcccctcccttgtatgggagccctgttttcactctattaaatcttgccactgcacactcttctggtccgtgtttgttacttctcgagctgagctttcgctcgccatccaccactgctgtttgctgtcgtcgcacacctgctgctgacttccacccctccagatccagcagggtgtccgctgtgctcctgatccagcgaggtgcccattgctgctcctgatcgggctaaagactcgccattgttcttgcatggctaaatgcctgggttcgtcctaattgagctgaacactagtctctgggttccatggttctcttctgtgacccatggcttctaatagagctataacactcaccgtaaggcccaaggttccattccttggaatctgtgaggccaagaaccccaggtcagagaacaaaaggcttgctgccatcttgggagtggccgccaccatcttgggggagttctaagaacaaagacccactcataacaatt

SEQ ID NO: 130 - DNA, 954 bp, Homo sapiens
gtggggaaaagagagagagatcagattgttactgtgtctgtgcagaaagtagacataggagactcccattttgttctgtattaagaaaaattcttctgccttgagatgctgttaatctgtaaccctacccccaaccctgtgctccctgaaacgtgtgctgtgtcaactaagggttaaatggattaagggctgtgcagggtgtgctttgttaaacaaatgcttgaaggcagcatgctagttaagagtcatcaccactccctaatctcaagtacccagagacacaaaacactgcggaaggctgcagggacctctgcctaggaaagccaggtattgtccaaagtttctccccatgtgatagtctgaaatatggcctcgtgggaagggaaagacctgaccgtccggcagcccgacacccataaagggtctgtgctgaggaagattagtaaaagaggaaggaacgcctctttgcagttgagataagaggaaggcttctgtctcctgcttgtccctgagcaatggaatgtcttggtgtaaagcccgattgtatactccatctactgagacaggggaaaaccgccttagggctgaagatgggacatgctggcagcaatactgctccttaaggcattgcgatgtttatgtatatgcacatcaacagcacagcacttttttctttaccttgtttatgatgcagagacatttgttcacgtgtttaccttctgaccttctctgcactattatcctattatcctgccacacccaataatgatcaataaatactaagggaactcagaggccggtgccggcgtggatcctccgcatgctgaacgctggtcccctgggcccccttttttctttctctatactttgtctctgtgtctctgtcttttccaagtctcttgttccacctaatgagaaacacccacaggtgtggaggggcaacccactccttca

SEQ ID NO: 131 - DNA, 692 bp, Homo sapiens
ttagggtaagtagtcagacaggcatgaggaggacaggagaggccccccgctccaggaatgtcaggtgtctatcaggtgatggtcatgcagttgttaaactgtctctctaaaataagaattggtcacagccagcaccagggaaagacagtctcccaattgatagaaaacagctgaagctggtgatcagtagcttcccgataagctctcaggaggtggacaagccgactcaagcatgcacactatgaggcaaaatggcagagtttaactggtatatgaccttcctctaggaatactcaactggctagggaaaaatacctccagtgagcatgcatggaacaccagtaagcacactgtgcatgtggcccctccgaagtgctggcatgccactgtgcctgcagacacccaccccaagggaaggatcaggagagacacaaatccggaagcatgccaacatagaaaagcccaagtcaaaggccgcacagcacacttggatctcacaaatcacacacttcatcctctttgaagtgcactttacttcctttgaccctgctctaaaactttttaaataaaatttcactcttgttctaaaacttgcctcaatctctcactctgccttatgccccttggatgaattttttttctctggggaggcaagaattgaattgctgcagacccatacggatttaccaatg

SEQ ID NO: 132 - DNA, 5307 bp, Homo sapiens
gtcaggtctctgagcccaagctaagccatcatatcccctgtgacctgcacatacacttccagatggccggttcctgccttaactgatgacattatcttgtgaaattccttttcctggctcatcctggctcaaaaagttcccccactgagcaccttgtgaccccccacccctacctgccatagaacaaccccctttgactgtaattttcctttacctacccaaatcctataaaacggccccacccctatctcccttcactgactctcttttcagactcagcccgcctgcacccaggtgaaataaacaccttgttgctcatgtaaagcctgtttggtggtctcttcacagggacgggagagaaatttggtgctgtgactcagatcgggggacataccttgggagatcaatcccctgtcctcctgctgtttgttacatgagaaagatccacctatgacctctggtcttcaggccgaccagcccaaggaacatctcaccaattttaaatcgggtaagcagcctctttttactctcttctccaacctccctcactatccctcaacctctttctcctttcaatcttggcgccacacttcaatctctcccttctcttaatttcaattcctttcattttctggtagagacaaaggagacacattttatccatggacccaaaactccggcgccggtcacggacttgggaaggcagccttcccttggtgttgaatcactgcggggactcttctctgactattcacccattttccattggtgtctgatctccatggggatgcctgccttgatcattcacccacgttcccttggtggcaagtcaattgcggggacgcctgctttggctgatcacccatgttgcagcccagggctgctccccacccccttctccctgtctctacacttctctttaaacttgcctcctttactatgggcaaccttccttcttctcctccttcttctcccttagcctgtgttcttaagaacttaaaacctcttcaagtcacacctgacctaaagcctaaatgccttattttcttctacaatgctgcttgaccccagtacaaacttgacagtggttacaaatagccagaaaacggcactttcaatttttccatcctacaagatctaaataattcttgttgtaaaatgggcaaatggtctgacgtccaggcattcttttacacattgttccctccctagtctctgttcccaatgtgaatcatcccaaatcctccttctttccctctcgcctgtccccagtcccaaccccaagcatcgctgagtcttcctaatcttcctcttctacagacccatctgacctctcccctcctccccaggctgctcctcaccaggccgagctaggtcccaattcttcctcaggctctgctcctccactcaataatctttttatgacctccccccctcacaccctatctggcttacagtttcattccacgactagccctcccccacctgcccagcaatttcctcttaaaaatgtggctggagctaaacgcatagtcaaggttaatgctcctttttctttatccgacctctcccaaatcagttagcatttaggctctttttcatcaaatatgaaaaacccagcccacttcatggctcatttggcagcaaccctgagatgctttacagccctagaccctaaaaggtcaaaaggccgtcttattctcaatatacattttattacccaatctgctcctgcctttaaataaagctccaaaaattaaattccagccctcaaaccccacaacaggacttaattaacctagctttcaagatgtacaataatagaaaaaagttgcaattcctcgcttccactctgagacaaaccccagccacatctccagcacacaagaacttccaaacacctgaaccacagtggccaggcgttcctccagaacctcctcccacaggagcttgctacaagtgccagaaatctggccactgggccaagaaatgcccacagtcggggattcctcctaagccgcgtcccatctctgcgggaccccactgaaaatcggactgttcaactcacctggcagccactcccagagccctggaactctggcccaaggctctctgactccttcccagatcttcttggcttagcggctgaaggctgacactgcctgattgcctcagaagccccctaaaccatcagggacgccgagcttcgggtaactctcacaatggaaggtaagtccgtccccttcttaatacagaggctacccactccacacattaccttcttctcaagggcctgtttcccttgcctccataactgttgtggttattgacagccaggcttctaaacctcttaaaactccccaactctggtgccaacttagacaatactcatttaagcactcctttttagttatccccacctgcccagttcccttattaggccgagacactttaactaaattatctgcttccctgactattcctgggctacagccacacctcattgctgccttttcccccagttcaaagactccttcacatcctccccttgtatctccccaccttagcccacaagtttcggatacctctactccttccttggcgactgatcatgcaccccttaccatctcattaaaacctaatcacccttaccccactcaatggcaatatcccatcccacaggacgctttaaaaggattaaggtctgttgtcattcgcctgctgcagtatggccttttaaagcctataaactccccttacaattccccattttacctgtcctaaaaccagacaagacttacaggttagtagttcaggatctgcgccttatcaaccaatttgttttgcctatccaccccatggtgccaaacccatatactctcctatcctcaatacctccctccacaacctattattctgttctggatctgaaacatgctttctttactattcctttgcatccttcatcccagcctctcttcgctttcacttggactgaccctgacactcatcaggctcagcaaattacctgggctatactgccgcaaagcttcactgacagcccccattacttcagtcaagcccaaatttcttcctcatctgttacctatcttggcataattctcataaaaacacatgtgctttccctgccgatcatgtccgactgatgtctcaaactccagcaccttctacaaaataacaactcttttccttcctaggaatggcttgatactttcgactttagatacctggttttgccatcctaacaaaaccattatataactcacaaaaggaaacctagctgaccccatagaccctaaatcctttcccccactcctctatctgttccttgaagacagctttagaaactgcccccaccctagctctccctgactgatcccaacccttttcattatccacagctgaagtgcaaggctgtgtagtcagaattcttacacaagaaccgggaccgtgccctgtagcctttttatccaaaacttgaccttactgttttgcctagccctcaagtctgcgtgcagtggccgccactgccctaataattttagaggcccttaaaatcacaaactatactcaactcactctctacagttctcataacttccaaaatctattttcttcctcacacctgacacatatagtttccgctccctggttccttcagctgtactcactctttgttaaatctcccacaattaccattgttcctggcccagacttcaatctggcctcccacattattcctgataccacacctgacccccatggctgtatctctctgatccacctgacattcatcccatttccccatatttccttctttcctgttcctcaccctgatcacgctcagtttattgatggcagttccaccaggcctaatcaccacacaccagcaaaggcaggctatgctatagtacaagccactagcccgcctcttagaacctctcatttcctttccatcgtggaaatctatcctcaaagaaataacttctcagtgttccatctgctattctactacttctcagggattattccggccccctgccttccctacacataaagctcagggatttgcccccgcccaggactggcaaattagctttactcaacatgccccaagtcaggaaactaaaatacctcttggtctaggtagacactttcactggataggtagaggcctttcccacagggtctaagaagtccaccacggtcatttcttcccttctgtcagacataattcctcggtttggccttcccacctctatacagtctgatagcagaccggcctttattagtcaaatcagccaagcatttttttcaggctcttggtattcagtgaaacctttatatcccttacagtactcagtcttcaggaaaggtagaatggactcgtggtcttttaaaaacatacctcaccaagttcatccaccaacttaaaaaggactagacaatacttttaccaatttcccttctcagaattcaggcctgtcctcagaatgctacagggtacagcccatttaagctccagtatagatgctcctttttattaggccccagtctcattccagacaccagaccaacttggactctgccccaaaacacttgtcatccctagtatattctgtctagtcatactcctattcgccattctcaactactcatacatgccctgctcttgtttacactgccagtttacactatttctctaagccaccacagttgatatctcctggtgctatccccaaactgccactcttaactcttgaagcaaataaataatctctgctggcagggctatgctgaatctccttaggcactctctaattaaatgtcctaggtcctcccagttcttagacctttatacctgtttttctccttctcttattccatttagtttttcaattcatacaaaaccgtatccaggccatcaccaataattctaaatgacaaatgtttcttctcacaaccccacaatatcaccccttaccacaaaatcttccttcagcttaatctctcccactctaggttcccacaccacccctaatcccgctcgaagcagccctgagaaacattgcccattatctctccataccaccccccaaaaattttcaccgtcccaacattttacctctatttcactttatttttcttattaatataagaagacaggaatgtcaggcctctgagcccaagctaagccatcatatcctctgtgacctgcacatacacatccagatggccagttcctgccttaactgatgacattccaccacaaaagaagtgtaaatg

SEQ ID NO: 133 - DNA, 1137 bp, Homo sapiens
accccatgcacccaagtcttagcaggcatgattatagccaccagccacctgggcatgtgggcagcctcaggattttttggagctgtactcaaccccttattttattttgcctctcaccttcagaccatcaagctccagatgatcctcagtgagggatgccatactctcaatattcaagagtcactcttctacagagaattcctaggctgcccatcagaggaacatgacaaaggtgaaatcctgcccctgtctctcttggacctggatggataccacttccatcaacccatagagccaccctgccctgacatctagcaagaggccaagacccgcaaaacaaccaccactatccctctatcaccaggaagcaactacaaaaaagtgatccttatccattttccccaaagaactggggtcttggactcttgaagagggaaatgttacagtaggtaggtagtcagacataagcagggcaagagagtcctctccccaccaggaatgtcaggtgatcatcaggtgatagtcaggtgattgttaaactgtttctctagaataacaattggttgcagctggagccagggaaaggcagtttcccaatagacagaaaatacatgaagctggtgatcggcagcttctgataagatctcaggagttggacaagtggactcaagcatgcacactaaaaggcaaaattgcagagttaatctgatatatgaccttcctgtaggaacactcaacttgtaaaggaagaacgcctcaagtgagcatgcacacaagttcattaaaagcactgtgcatgtggtccctcccaagtgctggcaggccagactgcccaggccagaggaagaatcaggggagaaaagatgcgaccccctggaagcatgccaatgtataaaaccccaagtcaaaggtcaaaccacgcacttgaatctctcaagttgcctgtgtggccctcttacaagtgtactttatttcctattgttcttgctctaacaccctttaataaactttcacttctgctttaaaacttgccttggtctcttactttgctttatgcccctcagttgaattctttcttctgaggaggcaagaattgaggttgctgcaggcccgtacagattcactgctgctaacata

SEQ ID NO: 134 - DNA, 1080 bp, Homo sapiens
tctgcaggtgtacccaacagctccgaagagacagcgaccatcgagaacgggccatgatgacgatggcggttttgtcgaaaagaaaagggggaaatgtggggaaaagcaagagagatcagattgtcactgtgtctgtgtagaaagaagtagacatgggagactccattttgttatgtactaagaaaaattcttctgccttaagattctgtgaccttacccccaaccccgtgctctctgaaacatgtgctgtgtcaaactcagggttaaatggattaagggtggtgcaagatgtgctttgttaaacagatgcttgaaggcagcatgctcgttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtatgagaggaaggcatgcctcttgcagttgagacaagaggaaggcatctatctcctgcccgttcctgggcaatggaatgtctcggtataaaacccgattgtatgttccatctactgagatagggaaaaaccgccttagggctggaggtgggacaagcaggcagcaatactgctttgtaaagcattgagatgtttatgtgtatgcatatctaaaagcacagcacttaatcctttaccttgtctatgatgcaaagaactttgttcacgtgtttgtctgctgaccctctccccacaattgtcttgtgaccctctccccacaattgtcttgtgaccctgacacatccccctcttcgagaaacacccacgaatgatcaataaatactaagggaactcagaggctggcgggatcctccatatgctaaacgctggttccccgggtccccttatttctttctctatactttgtctctgtgtctttttcttttccaagtctctcattccaccttacgagaaacacccacaggtgtggaggggcaacccaccccttca

SEQ ID NO: 135 - DNA, 5924 bp, Homo sapiens
tggggcaaactaaaagtaaaattaaaagtaaatatgcctcttatctcagctttattaaaattcttttaaaaagagggggagttaaagtatctacaaaaaaatctaatcaagctatttcaaataatagaacaattttgcccatggtttccagaacaaggaactttagatctaaaagactggaaaagaattggtaaggaactaaaacaagcaggtaggaagggtaatatcattccacttatagtatggaatgattgggccattattaaagcagctttagaaccatttcaaacagaagaagatagcgtttcagttcctgacgcccctagaagctgtatagtagattgtaatgaaaagacaaggaaaaaatcccagaaagaaatggaaagtttacattgcgaatatgtagcagagccggtaatggctcagtcaacgcaaaatgttgactataatcaattacaggaggtgatatatcctgaaacgttaaaattagaaggaaaaggtccagaattagtggggccatcagagtctaagccacgagggccaagtcctcttccagcaggtcaggtgcccgtaacactacaacctcaaacgcaggttaaagaaaataagacccaaccgccagtagcttatcaatactggccgccagccgaacttcagtatcggccacccccagaaagtcagtatggatatccaggaatgcccccagcaccacagggcagggcgccataccctcagccgcccactaggagacttaatcctacggcaccacctagtagacagggtagtgaattacatgaaattattgataaatcaagaaaggaaggagatactgaggcgtggcaattcccagtaacgttagaaccgatgccacctggagaaggagcccaagagggagagcctctcacagttgaggccagatacaagtctttttcgataaaaatgctaaaagatatgaaagagggagtaaaacagtatggacccaaatccccttatatgaggacattattagattccattgctcatggacatagactcattccttatgattgggagattctggcaaaatcgtctctctcaccctctcaatttttacaatttaagacttggtggattgatggggtacaagaacaggtccgaagaaatagggctgccaatcctccagttaacatagatgcagatcaactattaggaataagtcaaaattggagtactattagtcaacaagcattaatgcaaaatgaggccattgagcaagttagagctatctgccttagagcctgggaaaaaatccaagacccaggaagcgcctgcccctcatttaatacagtaagacaaggttcgaaagagccctaccctgattttgtggcaaggctccaagatgttgctcaaaagtcaattgccaatgaaaaagcccgtaaggtcatagtggagttgatggcatatgaaaacgccaatcctgagtgtcaatcagccattaagccattaaaaggaaaggttcccgcaggatcagatgtaatctcagaatatgtaaaagcctgtgatggaatcagaggagctatgcataaagctatgcttatggctcaagcaataacaggagttgttttaggaggacaagttagaacatttggaggaaaatgttacaattgtggtcaaattggtcacttaaaaaagaattgcccagtctcaaataaacagaatataactattcaagcaactacaacaggtagagagccacctgacttatgtccaagatgtaaaaaaggaaaacattgggctagtcaatgtcgttctaaatttgataaaaatgggcaaccattgtcgggaaacgaccaaaggggccagcctcaggccccacaacaaactggggcattcccaattcagccatttgttcctcagggttttcagggacaacaaacccactgtcccaagtgtttcagggaataagccagttaccacgatacaacaattgtcccccgccacgagcggcagtgcagcagtagatttatgtactatacaagcagtctctctgcttccaggggagcccccacaaaaaatccccacagaggtatatggcccactgcctgagaggactgtaggactaatcttgggaagatcaagtctaaatctaaaaggagttcaaattcatactggtgtggttgattcagactataaaggcgaaattcagttggttattagctcttcaattccttggagtgccagtccaggagacaggattgctgaattattactcctgccatatattaagggtggaaatagtgaaataaaaagaacaggagggtttggaagcactgatccgacaggaaaggctgcatattgggcaagtcaggtctcagagaacagacctgtgtgtaaggccattattcaaggaaaacagtttgaagggttggtagacactggagcagatgtctctatcattgctttaaatcggtggccaaaaaattggcctaaacaaaaggctgttacaggatttgtcggcataggcacagcctcagaagtgtatcaaagtactgagattttacattgcttagggccagataatcaagaaagtactgttcagccaatgattacttcaattcctcttaatctgtggggtcgagatttattacaacaatggggtgcggaaatcatgcccgctccattatatagccccacgagtcaaaaaatcatgaccaagatgggatatataccaggaaagggactaggaaaaaatgaagatggcattaaagttccagttgaggctaaaataaatcaagaaagagaaggaatagggtatccttgttaggggcagccactgtagagcctcctaaacccataccattaacttggaaaacagaaaaaccggtgtgggtaaatcagtggccgctaccaaaacaaaaactggaggctttacatttattagcaaatgaacagttagaaaagggtcacattgagccttcgttctcgccttggaattctcctgtgtttgtaattcagaagaaatcaggcaaatggcgtatgttaactgacttaagggccgtaaacgccgtaattcaacccatggggcctctccaacccgggttgccctctctggccatgatcccaaaagactggcctttaattataattgatctaaaggattgcttttttaccatccctctggcggagcaggattgcgaaaaatttgcctttactataccagccataaataataaagaaccagccaccaggtttcagtggaaagtgttacctcagggaatgcttaatagtccaactatttgtcagacttttgtaggtcgagctcttcaaccagttagagacaagttttcagactgttatattattcattatattgatgatattttatgtgctgcagaaacaaaagataaattaattgactgttatacatttctgcaagcagaggttgccaatgcaggactggcaatagcatctgataagatccaaacctctactccttttcattatttagggatgcagatagaaaatagaaaaattaagccacaaaaaataaaaataagaaaagacacattaaaaacactaaattattttcaaaaattgctgggagatattaattggattcggccaactctaggcattcctacttatgccatgtcaaatttgttctctatcttaagaggagactcagacgtaaatagtaaaagaatgttaaccccagaggcaacaaaagaaattaaattagtggaagaaaaaattcagtcagcgcaaataaatagaatagatcccttagccccactccaacttttgatttttgccactgcacattctccaacaggcatcattattcaaaatactgatcttgtggagtggtcattccttcctcacagtacagttaagacttttacattgtacttggatcaaatagctacattaattggtcagacaagattacgaataataaaattatgtggaaatgacccagacaaaatagttgtccctttaaccaaggaacaagttagacaagcctttatcaattctggtgcatggcagattggtcttgctaattttgtgggaattattgataatcattacccaaaaacaaagatcttccagttcttaaaattgactacttggattctacctaaaattaccagacgtgaacctttagaaaatgctctaacagtatttactgatggttccagcaatggaaaagcagcttacacagggccgaaggaacgagtaatcaaaactccacatcaatcggctcaaagagcagagttggttgcagtcattacagtgttacaagattttgaccaacctatcaatattatatcagattctgcatatgtagtacaggctacaagggatgttgagacagctctaattaaatatagcatggatgatcagttaaaccagctattcaatttattacaataaactgtaagaaaaagaaatttcccattttatattactcatattcgagcacacagtaatttaccagggcctttgactaaagcaaatgaacaagctgacttactggtatcatctgcattcataaaagcacaagaacttcatgctttgactcatgtaaatgcagcaggattaaaaaacaaatttgatgtcacatggaaacaggcaaaagatatcgtacaacattgcacccagtgtcaagtcttacacctgcccactcaagaggcaggagttaatcccagaggtctgtgtcctaatgcattatggcaaatggatgtcacgcatgtaccttcatttggaaaattatcatatgttcatgtaatagttgatacttattcacatttcatatgggcaacttgccaaacaggagaaagtacttcccatgttaaaaaaacatttattgtcttgttttgctgtaatgggagttccggaaaaaatcaaaactgacaatggaccaggatattgtagtaaagctttccaaaaattcttaagtcagtggaaaatttcacatacaacaggaatgccttataattcccaaggacaggccatagttgaaagaactaatagaacactcaaaactcaattagttaaacaaaaagaagcaggagacagtaaggagtgtaccactcctcagatgcaacttaatctagcactctatactttaaattttttaaacatttatagaaatcagactactacttctgcagaacaacatcttactggtaaaaagaacagcccacatgaaggaaaactaatttggtggaaagataataaaaataagacatgggaaatagggaaggtgataacgtgggggagaggttttgcttgtgtttcaccaggagaaaatcagcttcctgtttggatacgcactagacatttgaagttctacaatgaacccatcggagatgcaaagaaaagcacctccgcggagacggagacaccacagtcgagcaccgttgactcacaagatgaacaaaatggtgacgtcagaagaacagatgaagttgccatccaccaagaaggcagagccgccaacttgggcacaactaaagaagctgacgcagttagctacaaaatatctagagaacacaaaggtgacacaaaccccagagagtatgctgcttgcagccttgatgattgtatcaacggtggtaagtctccctatgcctgcaggagcagctgcagctaactatacctactgggcctatgtgcctttcccgcccttaattcgggcagtcacatggatggataatcctatagaagtatatgttaatgatagcgtatgggtacctggccccacagatgatcgctgccctgccaaacctgaggaagaagggatgatgataaatatttccattgggtatcgttatcctcctatttgcctagggagagcaccaggatgtttaatgcctgcagtccaaaattggttggtagaagtacctactgtcagtcccatcagtagattcacttatcacatg

SEQ ID NO: 136 - DNA, 175 bp, Homo sapiens
cccagaggtttctttgtttgggaaaataagaccaagggagctaatcaaagccaagccccatgaatacaaaccttagcaggcataactatagccacgagttatctggctgtattggcagccttgagatttttgttttgttttgttttgagctgtccttatccctttgtttcatttt

SEQ ID NO: 137 - DNA, 6713 bp, Homo sapiens
gtcaggcctctgagctgaagctaagccatcatatcccctgtgacctgcacatatacatccacctggcctgaagcaactgaagatccacaaaataagtgaaaataaccttaactgatgacattccaccattgtgattttttcctgccccaccctaactgatatgatatattctcccccgcccttaagaaggtactttgtaatattctccccagtcttgagaatgtactttgtaatattgtccccactcttgagactgtactttgtacgcctatcccaaacctataagaactaatgatgatcccaccaccatttgctgagtcctttttcggactcagcccgcccacacccagatgaaataaacagccttgttgctcacacaaagcctgttggtggtctcttcacacagacgtgcgtgacgtttggtgccaaaactcgggacgggaggactccttcgggagaccggtcccctgtcctcaccttcactgggtgaggagatccacctacaactcgggtcctcagaccaaccagccaaaggaacatctcaccaatttcaaatcaggtaagtggtcttttcgctcttctccagcctctctcactaccctccagccttcctctctcgctacccttcaatcttcctgtccttccaattccagttctttttcttctctagtagagacaaggagacacattttatccatggacccaaaactccggcgccagtcacggactcgggaagacagcctttccttggtgtttaatcaccgcggggacgcctgcctgattattcacccacactccattggtgtctgatctccacggggacgcctgcctgattattcacccacattcccttggtggtcagtcaattgtggggatgcctgctttggctgctcacccacattgcagcccagggctgctcactaccccctcttctccgtgtctctaccctctctgttctctgggcttgcctccttcactatgggcaaccttccaccctccattcctccttcttctcccttagcctgtgttctcaaagacttaaaacctcttcaactcagacctgaactgaaacctaagcgtcttattttcttctgcaacaccgcttggccccagtacaaactcgacaatgattccaaatagccagaaaatggcactttcaatttctccatcccacaagatctagataattcttgtcataaaatggacaaatggtctgaggtatctgatgtccaggcattcttttacacttcagtcccttcctaatctctgctcctgatgagactcatcccaaaactttcttctttctctcctgtctgttccttcagtctccaccccaagctctgagtcctttgaatcctccttttccacagactcatctgacctctcctcttctcctcaggctgctcctcgccaggctgagccaggtcccaactcttcgccagcctctgctcccccaccctataatccttctatcacttcccctcctcacaccgggtctggcttacagttttgttctgcgtctagccctcccccacctgcccaacagtttcctcttagagaggtggctggagctgaaggcatagccaaggttaatgctcctttttctttacccaacctctcccaaatcagttagtgtttaggctctttttcatcaaatatgaaaaccccgctcagtccatggcccgtttggcaacaacccttagatgctttaccgccctagacccagaggggccagaaggccgtcatattctcaatatgcattttattacccaatccgctcctgacattagaaaaagctccaaaaattggattctggccctcaaccccacaacaggacttaattaacctcaccttcaaggtgtacaataatagagaagagttgcgattacttgcctcttctgtgagagaaaccccagccacatctccagcacacaagaacttcagaacgcctaaactgcaagggtcaggcattcctccaggactgccttccccaggatcttgcttcaagtgccagaaatctggccactggggcaaggaatgcccacagcccaggattcctcctaagccatgccccacctgtgcaggaccccactggaaatcggactgtccaactcgcccagcagacagtcccagagcccctcgaactctggctcaaggttctctgactgactccttcccggatcttctcggcttagtggctgaagactgacgctgtccgattgcctcagaagcctcctggaccatcacggacgctttgagtaactcttacagtggagggtaagtctgtccccttcttgatcaatacggaggctacccactccacattaccttcttttcaaaggcctgtttcccttgcctccataactgttgtgggtattgacagccaggcttctaaacctcttaaaactccccaactctggcgccaactgggacaacattcttaactccccaactctggcgccaacttggacaacattcttttatgcactctttttttatttatccccacctgcccagctcccttattaggtcaggacactttaaccaaattttcttcttccctgactactcctgggctacagccacacctcattgccgcccttttccccagttcagagcctccttcacgtcctccccttgtgtcttcctaccttaatccacaagtatgggacacctctactccctccttagtgactgatcatgcaccccttaccatcccattaaaacctaatcacccttaccctgctcaatgccaatatcctatcccacagcacactttaaaaggattaaagcctgttatcactcacccgttacagcatggccttttaaagcctataaactctccttacaattccccccttttacctgtgcaaaaactggacaagccttataggttagttcaggatctgtgccttatcaaccacattgtcttgcctatccaccctatggtgccaaatccatatactctcctatcctcaatacctccctccacaacccattattctgtcctggatctcaaacatggtttctttactattcctttgcacccttcatcccagcctctctttgcttttacctggactgaccctgacacacgtcagtcccagcagcttacctgggctatagtgccacaaggcttcagggacagccctcattacttcagccaagccctttctcgtgatttactttctttccacccctctgcttcccaccttattcaatacatggatgaccttttactttgtagtccctcctttgagtcttctcagtaagataccctcctgctccttcaacatttattctccagaggatatcaggtatcccccctccaaagctcaaatttcttccccatccgttacctacctcagcataattcttcatgaaaacatgcatgttctccctgccaatcatgtctggctaatctctcaaactccaaccccttctacaaaaaaacaacttctttccttcctgggcatggttggatactttcatctttggatacctggttttgccgtactaacaaaacctaatgtaaactcataaagggaaacctagctgaccccatagatcctaaatcctttccctactcctctttccgttccttgaagacagctttagagactgctcccacactagctctccctgactcatcccaacccttttcattacacacagccaaagtacagggctgtgcagtcggaatttttacacaaggaccaggattcctacacaaggctactgtgccctgtagcctttttgtccaaacaacttgaccttactgttttaggctggccatcatgtctctgtgcagcagctgccactgccttaatacttttagaggcccttgaaatcacaaactgtgctcaactcactctctacagttcttataacttccaaaatctattttcttcctcacacctgatgcatatactttctgctctccggctccttcagctatactcactctttgttgagtctcccaaaattaccattgttcctggcccagacttcaatctggcctcccacattattcctgataccacacttgacacccatgactgtatctctctgatacacctggcattcactccatttccccatatttccttctttcctgttcctcaccctgatcacacttggtttattgatggcagttccatcaggcctaattgccactcaccagcaaaggcaggctatgctatagtatcttccatatttatccttgaggctaccactctgccccactccactacttctcagcaagccaaactcattgccttaactcaggccctcactcttgcaaagggactacacatcaatatttatactgactctaaatatgccttccatatcctgtaccaccatgctgttatatgggcagaaagaggtttcctcactacgcaagggtcctccatcatcaatgcctccttaataaaaagtcttcttaaagctgctttacttccaaaggaagctggagtcattcactgcaagggccatcaaaaggcatcggatcccatcgctcagggcaatgctaaagaagcagctagcattccaacttctgtccctcatggccggtttttctccttctcatcagtcactcccacctactcccccaccgaaacttccacctatcaatctcttcccacacaaggcaaatggttcttggaccaagaaaaatatctccttccagcctcacaggcccagtctattctgtcgtcctttcataacctcttccatgtaggttacatgccactagcctgcctcttagaacctctcatttcctttccattgtggaaatctatcctcaaggaaatcacttctcagtgttccatctgctattctattactcctcagggattgttcaggccccctcccttccctacacatcaagctctgggatttggccctgcccaggactggcaaattgactactcacatgccctgagtcaggaaactaaaatacctcttggtctgtgtagacactttcactggatgggtagaggcctttcccacagggtctgagaagtccaccgtgatcatttcttcctttcttttagacagaattcctgggtttgtccttcccacctctatacagtctgataacgcaccggcctttattagtcaaatcacccaagaaggttctcaggctcttggtatttggaggctcctggttttacttcaaatcaccacccttaagtcgctcttgaagtcgatagaagatcttcagtggcaaggtaccctccagtactttcaccctgatgaagtcctattctttacttttatactcactcttattctggttccgttcttatgctaccctctacctctccccagctatctccaccacactatcaaactctctcttagccatttctaatccttcttaaatgaacaattgctggctttgcatttctctttcctccaaaattgccgaggcatcgacttactcactgctaaaaaaaagaggactctgtatatttttaaacgaagagtgttgtttttacctaaatcaatctggacaggtatatgacaacataaaaaaattcaaggatagaggccaaaaactcaccaaccaagcaaataattatgttgaacccccttggacactgtctaattagatgttctgggtactcccaattcttagtcctttaatacctatttttctggctgggtgtggtggctcatgcctgtaatcccagcactttgggaggctgaggtggacggatcacgaggtcatgagattgagaccatctggctaacatggtgaaacccccttctctactaaaaatacaaaaaaattagtcgggcgtggtggcgtgcacctgtagtcccagctactcaggaagctgaggcaggagaatcgtctgaaccagggaggcagaggttgcagtgagccgagatcgtgccactgcactccagcctgggcaacagagcgagactctgtctcaaaaaaaaaaaaaaaaaaaaaaaaccaacctatttttctccttcttttattcagaccttgtgtcttccgtttagtttctcaattcatacaaaaccgcatccaggccatcaccaataattctatacgacaaatgctccttctaacaactccaaaatatcaccttaccccaaaatctttcttcagcttaatctctcccaccacaggttcccacgctgcccctaatcccgcttgaagcagccatgagaaacatcgcccattatctctccataccaccccccaaaattttcgccaccccaacacttcaccactattttgttttttcttattcatataagaagacaggaatgtctggcctctgagcccaagctaagccatcatatcccctgtgacctgcatgtatacatccagatggcctgaaacaactgaagatccacaaaaaaaagcgaaaatagccttaactgatgacattccaccattgtgatttgttcctgccccaccccaactgataccatatagtctcccctgcccttaagaaggtactttgtaatattctcccccacacttaagaatgtactttgtatgcctttaagaatgtacacttataggtttgggataggtttatcccaaacctgtaagaactaatgataatcccaccaccctttgctgactcctttttctggttcagcccacctgcacccaggtgaaataaacagccttgttgctcacacaaaacctgttggtggtctcttcacatggacacgtgtga

SEQ ID NO: 138 - DNA, 453 bp, Homo sapiens
gtcaggcctctgagcccaagtcaagctatcgcatcccctgtgacttgcacgtatacgcccagatggcctgaaataactgaagaatcacaaaagaagtgaatatgccctggccacaccttaactgatgacattccaccacaaaagaagtgtaaatggctggtccttgccttaactgatgacattaccttgtgaaagtccttttcctggctcatcctggctcaaaaagcacccccactgagcaccttgtgacccccactcctgcccgccagagaacaaaccccctttgactgtaattttcctttacctacccaaatcctataaaacggccccacccttatctccctttgctgactctcttttcggactcagcccgcctgcacccaggtgaaataaacagccatgttgctcacacaaagcctgtttggtggtctcttcacacggacgcccatgaaa

SEQ ID NO: 139 - DNA, 671 bp, Homo sapiens
ttagagtaggtagtcaggcagatatgggcaaggcaggaaaggcaggaatgtcaggcgacaatcaggtgatggtcaggcggttattaaactgtcactctaaaataattggttgcagtaggtgccagggaaaggcagtctcctaagagatagaaaacacctaaagctggtgatcagcagctttccaataagatctcaggaactgggcaagtgtgctcaagcatgcgtactaagaggcaaaatggcagattttaactggtatacaaccttcctctaggaacacttgactggtaagggaaaaacgcctcaaatgagaatgtgcacaacttcagtaaagacattgcacatgtggcccctcccaagtgctgacaggccactgcacgtgcagacagcccatgccaaggaaaaaatcaaaggagatacaaaacctcggaagcatgccaatgtataaaacgcaaagtcaaaagtcaaacagggcacctggatctctcaagttgcctgcttgcccctcttcctttggttcctgctctaaaactttctaataaactctcactcctgctcaaaaacttgcctcagtctctcactctgccttatgcctcttggatgaattctttcctttgaagaggcaagaatcaagttattgtagatccgtatggattcaccactgctaacat

SEQ ID NO: 140 - DNA, 2050 bp, Homo sapiens
tgcggtcagaattcttacacaagagccaggaccgcaccctgtagcctttctgtccaaacaacttgaccttactgttttagcctagccctcatgtctgcgtgcagtggctgccgctgctttaatacttttagaggccctcaaaatcacaaactatgctcaactcactctctacagttccataacttccaaaatctattttcttcctcatacctgatgcatatactttctgcttcctggctccttcagctgtactcactctttgttaagtcccacaattaccattgttcctggcccagacttcaatctggcctcccacattattcctgataccacacctgacccccatgactgtatgtctctgatccacctgatattcaccccatttccctatatttccttctttcctgttcctcaccctgatcatgcttgatttattgatggcagttccaccaggcctaatcgcctcacaccaccaaaggcaggctatgctatagtacaagccactagcccacctctcagaacctctcatttcctttccatcgtggaaatctatcctcaaggaaataactcctcagtgttccatctgctattctactactactcctggattattcaagccccctcccttccctacacatcaagcttgaggatttgcccccacccaggactggcaaatcagctttactcaacatgtccggagtcaggaaactaaaatacctcttagtctaaatagacactttcactgaataagtaaaggcctttcctacagggtctgagaaggccaccacagtcatttcttcccttctgtcagacataattcctcagtttagccttcccacctctatacagtctgataacagaccggcctttattagtcaaatcagccaagcagtttttcaggctcttagtattcagtgaaacctttatatcccttacagtcctcagtcttcaagaaaagtagaacggactaaaggtcttttaaaaacacacctcgccaagctcagccaccaacttaaaaaggactggacaatacttttaccactttcgcttctcagaattcaggcctgtcctcagaatgctacaaggcacagcccatttaagctcctgtatagacgctcctttttattaggccccagtctcattcgacaccagaccaacttagactgtgccccaaaaaaacttgtcatccctactatcttttttctagtcatactcctattcactgttctcaactactcatacatgccctgctcttgtttacactgctggtttacactgtttctccaagccatcacagctgatatctaccttttatacctgtttttctccttctcttattccatttagtttttcaattcatacaaaaccgtatccaggccatcaccaatcattctatatgacaaatgtttcttctaacaaccccacaatatcaccccttaccacaagacctcccttcagcttaatctctcccgctctaggttcccacgccgcccctaatcccgcttgaagcagccctgagaaacatcgcccattctctctccataccaccccccaaaaattttcactgccccaacacttcaacactattttgttttatttttcttattaatataagaaggcaggaatgtcaggcctctgagcccaagccaagccatcgcatcccctgtgacttgcacgtatacacccagatggcctgaagtaactgaagaatcacaaaagaagtgaatatgccctgccccaccttgactgatgacattccaccacaaaagaagtgtaaacggccagtccttgccttaagtgatgacattaccttatgaaagtccttttcctggctcattctcactcaaaaacacccccactgagcaccttgcgacccccactcctgcccgccagagaacaaaccccctttgactgtaattttcctttacctacccaaatcctataaaacggccccacctttatctccctttgctgactctctttttggactcagcccgcctgcacccaggtgaaataaacagccatgttgctttaccaattatttgtttgg

SEQ ID NO: 141 - DNA, 974 bp, Homo sapiens
gtaattgtggggaaaagcaagagagatcagattgttactgtgtctgtgtagaaagaagtagacataggagactccattttgttctgtactaagacaaattcttctgccttgagattctgttaatctatgaccttactcccaaccctgtgctctctgaaacatgtgctgtgtcaaactcagggttaaatggattaagggcggtgcaagatgtgctttgttaaacagatgcttgaaggcagcatgctcgttaagagtcatcaccactccctaatctcaagtatccagggacacaaacactgcggaaggccacagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtataagaggaaggcatgcctcttgcagttgagacaagaggaaggcatctgtctcctgcccgtccctgggcaatggaatgtctcggtataaaacccgattgtacgttctatctactgagatagggaaaaaccgccttagggctggaggtgggacatgcgggcagcaatactgctttgtaaagcattgagatgtttatgtgtatgcatatctaaaagtacagcacttaatcctttaccttgtctatgttgcaaagacctttgttcacgtgtttgtctgctgaccctctccccacaattgtcttgtgaccctgacacgtccccctcttagagaaacacccacgaatgatcaataaatactaagggaactcagaggctggcgggatcctccatatgctgaacgctggtcccccgggtccccttatttctttctctatactttgtctctgtgtctttttcttttccaagtctctcgttccaccttacgagaaacacccgcaggtgtggaggggcaacccaccccttca

SEQ ID NO: 142 - DNA, 3922 bp, Homo sapiens
tgcagtcagaattcttacacaagagccaggaccgcaccctgtaacctttctgtccaaacaaactgaccttactgttttagcctagccctcatgtctgcaggcagtggctgccactgctttaatacttttagaggccctaaaaatcacaaactatgctcaactcactctctacagctctcataatttccaaaatctgttttcttactcacacctgacacatatactttctgctccctggctccttcagctgtactcactcttcgttaagtcccacaattaccattgttcctggcccagacttcaatccagcctcccacattattccaaataccacacctgaccctcatggctgcatctctctgatccacctgacgttccccccatttccccatatttccttctttcctgttcctcaccctgatcatgcttgatttattgatggcagttccaaggcctaatcgccacacaccagcaaaggcaggctatgctatagtacaagccactagcccgcctcttagaacctctcatttcctttccatcgtggaaatctatcctcaaggaaataacttctcagtgttccatctgctattctactacttctcagggattattcaggccccctcccttccctacacatcaagcttgaagatttgcccccacccaggactggcaaattagcttcactcaacatgccccgagtcagataactaaaatacctcttagtctaagtagacactttcactagataagtagaggcctttcctacagcgtctgagaaggccaccgcagtcatttcttcccttctgtcagacataattcttcagtttagccttcccacctctatacgtctgataacagaccagcctttactagtcaaatcacccaagcagtttctcaggctcttggtattcagtggaaccttcatatcccttatcatcctcaatcttcaggaaaggtagaacggactaatggtcttttaaaggtacacctcaccaagctcagcctccaacttaaaaaggattggacagtacttttacctcttgctcttctcagaattagagcctgtcctcgagatgctacagggtacagtcgatttgaacttttatatggacgcactttcttgcttggccccaacctcatcccagacaccagccctctaggcgactatcttccagtcctccagcaggctagacaggctgctaatcttctcttgcctactccagatccccagccacatgaagacaccctagctggacgatcagttcttgttaagaatctgacccctcaaactctacaacctcgatggaccggaccccacttcatcatctatagtaccccgactgccgtctgcctgcaggatcctccccactaggttcaccattccagaataaagctgtgtccgtaggacagccagcctaatccctcctcttcctcctggaagttgcaagtactctcccctacttcccttaaactcactcgtatttctgaagaacagtaataacccttatgagcctaatacatcccttcattctattaggtctgctcgtccttaccttactttttgcagcaggactttaccaagtcacccccaccacttaggccgagtcccaaaaaactagtcatccctactatcttctgtctggtcatactcctattctccattctcaactacttataaatgccctactcttgtttacaccactggtttacactgtttcttcaagccatcacagctgatatctcttggtgctatccccaaactgccactcttaactccctcttagagtggatagatgatctttgctggcaaggcaccctccaatacttccaccctgatgaagttctattctttattttatactcactcttattctcattcccattcttatgccaccctctacctctccccagctatctccaccacactatcaaccttacccattctctcctagccgcttctaatacctccttagtgaacaactgctggctttgcatttccctttcttccagtgcctacacagctgtccccgccttacaggcagactgggcaacatctcccatctccctacacctccgaacttcctttaacagccctcacctttaccctcctgaagaactcatttactttctagacaggtccagcaagacttccccagacatttcacatcagcaagctgctgccctccttcgcacttatttaaaaaacctttctccttatattaactctactccccccatattcagacctctcacaacacaaactactattcctgtggccactcctttatgtatctctcggcaaagacccactggaattcccctaggtaaccttttaccttctcaatgttcatttactcctcatctccgaagcccaactacacacatcactgaaacaattggagccttcccgctccatgttacagacaagccctctatcaatactgacaaacttaaaaacattagcagtaattattgcttaggaagacacttaccctgtatttcactccatccttggctaccttccccttgctcatcagactctcctcccaggccctcttcttgtttacttatacccagccccgaaaataacagtgaaagattgctcgtagatactcaacgttttctcatacaccatgaaaatcgaacctccccctctaagcagttaccccaatcagtcctcattacaacctctgacagctgccgccctagctggatccctaggactctaggtacaagacacccctttcagctctccttctcatctttttactttacatctccagttttgcctcgcacaaggtctcttcttcctctgtggatcctctacctacatgtgtctacctgctaattggacaggcacatgcacagtagtcttccttacccccaaaattcaatttgcaaataggaccaaagagctccctgttcccctcatgacacccacacgacaaagaagagttgttccactaattcccttgatggtcggtttaggactttctgcctccactattgctctcggtactggaatagcaggcatttcaacctctgttatgaccttctgtagcctgtctaatgacttctgctagcatcacagacataacacaaactttatcagtcctccaggcccaagttgactcttaagctgcagttgtcctccaaaaccgccgaggccttgacttactcactgctgaaaaaggaggactctgcatattcttaaatgaagagtgttgtttctacctaaatcaatctggcttggtgtatgacaacataaaaaaactcaaggatagagcccaaaaacttgccaaccaagcaagtaattatgctgaacccccttaggcactctctaattggatgtcctaggtcctcccaattcttagtcctttaatacccattttcctccttcttttattcggaccttgtatcttccgtttagtttctcaattcatccaaaactgtatgcaggccatcaccaatcattccatatgacaaatgtttcttctaacatcaccaatcattctatatgacaaatgtttcttctaacatccccacaatatcaccccttaccacaagacctcccttcagcttaatctctcccactctaggttcccacgctgcccctaatcctgcttgaagcagccctgagaaacatcgcccattctctctccataccaccccccaaaaattttcgccgccccaacacttcaacactattttgttttatttttcttattaataaaagaaggtaggaatgtcaggcctctgagcccaagccaagccattgcatcccctgtgacttgcacgtatacatccagatggcctgaagtaactgaagatccacaaaagaagtaaaaatagccttaactgatgacattccaccattgtgatttgtttccgccccaccctaactgatcaatgtactttgtaa

SEQ ID NO: 143 - DNA, 570 bp, Homo sapiens
ttagagcaggtagtcagacagacatgagcagggcaggagagggacccccacaaccaggaatgtcaggcaaccatcaggggatggtcaagaggttgttaaactgtttctctaaaataataattggttgcagccagtgtcagggaaaggcagtcttccaaaaaaaaaaaaaatagaaaactgaagcttgtgatcagcagcttccagttaagatctcaggagtttgatgagcagcctcaagaatgagcactaaaaggcaaaattgcagagtttaactggtctataactttctaggaacacatgattggtaagagaaaacacctcaaatgagcatgtgcacaacttcagtaaacacactgtgcatgcagccccaccccagtgctgccaggccactgtgcatacggacagcctgcccaaagaaaaaatcaagggaggagagatacaaatccaagaaccatgccagtgtataaaacctcaagtcaagcgtcaaacagcgaacttggagttctaaagttgcctgcttggcccttttccaagtgtactttacttcctttcattcctgctctgaaactt

SEQ ID NO: 144 - DNA, 5619 bp, Homo sapiens
gtcaggcctctgagcccaagctatgccatcatatcccctgtgacctgcacatacacatccagatggtcggttcctgccttaactgatgacattccaccacaaaagaagtgaaaatggccgttcctgccttaactgatgacattgtcttgtgaaattccttctcctggctcattctggctcaaaagctcccctactgagcaccttgtgacccccactctgcccgccagagaacaacccccctttaactgtaattttcctttacctacccaaatcctataaaatggccccacccctatgtcccttcgctgactctcttttcggactcagcccacctgcacccaggtgaaataaacagttttattgctgactcaaagcctgtttggtggtctcttcacacgaacgcgagtgaaatttggtgccgtgacttggatcgggggacctcccttgggagatcaatcccctgtcctcctgctctttgctccatgagaaagatccacctatgacctcaggtcctcagaccaaccagccaagaaacatctccccaatttcaaatccggtaagcagcctctttttactctcttctccaacctccctcactatccttcaacctctttctcctttcaatcttggagccacacttcaatctctcccttcttttaatttcaattcctttcattttctggtagagacaaaggagacacgttctatccgtggacccaaaactccggcgccggtcacagactgggaagacagacttcccttgatgtttaatcattgcagggacacctctctgattatttacccacgtttcagaggtgtcacaccattcagggatgcctgcctcggtccttcacccttagcagcaagtcctacttttctgtgggaggggcaagtaccccaaccccttctctccatgtttctaccccttctccacctttctagggggcaaggaacccccaaccccttctccttcacccttagcagcaagtcccgcttttctaggggaggggcaagtaccccaacctcttatatctctgtgccccaatcccttatttccatgccccgacctcgtatctctgtgccctgacccctttcccacttttctggagggtaagaacccgtgaaccccttccctccgtgtctctactctctcttttctctgggcttgcctccttcactatgggcaaccttccatcctccattcctcctccttctcccttagcctgtattcttaagaacttaaaacctcttcaactctcacctgacctaaaatctaagcatcttattttcttctgcaatgccgcttgaccccagtgcaaactcgacagttgctctaaatggccagaaaacggcactttcaatttctccatcctacaagacctaaataatttttgtcgaaaaatgggcaaatggtctgaggtgcctgacatccaggcattcttttacaaatcggtccctccctagtctctgtgcccagtgggactcgtcccaaatcttccttctttccctcctgcctgtcccctcagtcccaaccccaagcgtcgctgagtctttctaatcttccttttctacagacccacctgacctctcccctcctctccaggctgctccttgccaggccgagctaggttccaattcttcctcagcctgtctccaccctataatctttttatcacctcccctcctcacacctggtccggcttacagtttcgttcggtgactagccctcccccacctggccaggaatttactcttaaaaaggtggctggagctaaaggcatagtcaaggttaatagtcctttttctttatcccaaatcagacagcatttaggctctttttcatcaaatataaaaatccagcccagttcatgactcgtttggcagcaaccctgagacactttacagccctagaccctaaaagttcaaaaggccatcttagtctcaaaatacattttattacccaatctgctcccgacattaaatgaaactccaaaaattaaattctgaccctccaaccccacaacaggatttaattaaccttgccttcaaggtgtacaataatagaaaaaagttgcaattccttacctccactgtgagacaaaccccagccacatctccagcacataagaacttccaaacgcctgaatcgcagtggccaggcattcctccagaacctcctcccccaggagcttgctgcaagtgccagaaatctggccactgggctaaggaatgcctgcagcccaggattcctcctaagccatgtcccatctgtgtgggaccccactgaaaattggactgttcaactcacctggcagccacttccagagcccctgggactctggtccaaggctgtctgactgactcctgcccagatcttctcggcttagcagctgaagactgacactgcccgatcgcctcagaagcctacaggaccatcacagatgctctaggtaactcttacagtggagggtaagtccgtccccttcttaatcaatacggaggctactcactccacattaccttcttttcaagggcctgtttcccttgcttccataactgttgtgggtattgacggccaggcttctaaacctcttaaaactccccaactctggtgccaacttagacaatactcttttaagcactcctttttagttatccccacctgcccagttcccttattaggccgagacactttaactaaattatctgcttccctgactattcctaggctacagccacacctcattgccacctttttctccagttcaaagcctccttcacatcctccctttgtatctccccaccttaacccacaagtataagacacctctactccctccttggtggccaatcatgcaccccttaccatttcattaaaatctaatcacccttaccctgctcagtgccaagatcccatcccactgcatgctttgaaaggattaaagcctattatcacttgcctgctagagcatggccttttaaagcctataaactctccttacaattcccccattttacctgtcctaaaaccagacaaggcttacaggttagttcaggatctgcaccttatcaaccaaattgttttgcctatccatcccatggtgccaaacccatatactctcctatccttaatacctccctctacaaaccattattctgtactggatttcaaacatactttctttactattcctttgcacccttcatcccagcctctctttgctttcacttagactgaccctgacacccattaggctcaacaaattacctgggctgtactgctgcaaggcttcacagacagcccccattacttcagtcaagcccaaatttcatcctcatctgttacctatctcagcgtaattctcataagaacacacgtgctctccctgctgatcgtgtccgattaatctcccaaacctcaatcccttacaaaacaacaactcctttccttcctaggcatggttagtgtggtcagaattcttacacaagagccaggactgcaccctgtagcctttctgtaaacaacttgaccttactgttttagcctagccatcatgtctccgtgcagcggctgctgccaccctaatacttttagaggccctcaaaatcacaaactatgctcaactcactctctacatttctcataacttccaaaatctattttcttcctcatacctgatgcatatactttctgttccccggctccttcagctgtacccactctttgttaagtcccactattaccattttcctggcccgtacttcaatctcgcctcccacattattcctgataccacacctgacctccatgactgtatctctctgatccatctgacattcaccccatttccccatatttccttctttcctgttcctcaccctgatcacgcttgatttattgatggcacttccaccaggcctaattgccacacaccagcaaagccaggctatgctatagtacaagccactagcccgcctcttagaacctctcatttcctttccatcctggaaatctatcctcaaggaaataacttctcagttgtccatctgctattctactactcctcagggattattcaggccccctcccttctctacacatcaagctcaaggatttgcccctgcccaggactggcaaattagctttactcaacatgccccaagtcacaaaaactaaaatacctcttagtctaagtagacactttcactagacaggtagaggcctttcctacagggtctgagaaggccaccgcagtcatttcttcccttctgtcagacataattcctcagtttagccttcccacctctatacagtctgataacagaccagcctttattagtgaaatcagccaagcagtttttcaggctcttagtattcagtgaaacctttatatcccttacagtcctccatcttcaggaaaggtagaacggactaaaggtcttttaaaaacacacctcaccaagctcagccaccaacttaaaaatggactggacaatattttaccactttcccttctcagaagtcagacctgtcctcagaatgctacagggtacagcccatttgagctcctgaatagatgctcctttttattaggccccagtttcatttgacaccagaccatcttagactgtgccccaaaaaacttgtcttccctactatctctgtctagtcatactcttattcaccgttctcaactactcatacatgccgtgctcttgtttacactgccagtttacactgtttctccaagccatcacagctgatatctcctggtgctatccccagactgccactcttaactcttgaagtaaataaataatctttgctgacaggactatgctgaatttccttaggcactcttatagatgtcctaggtcctcccaattcttagacctttaatacctgtttttctccttctcttactcggtttagtttttcaattcatacaaaaccgtatccaggccatcaccaataattctaaatgacaaatgtttcttctaacagtcccataatatcaccccttaccacaaaatcttccttcagcttaatctctcccactctaggttcccatgccgcccctaatcctgctagaagcagccctgagaaacattgcccattgtctctccataccacccccaaaaatttttaccgtcccaacactttaccactattttgttttatttttcttattaatataagaagacaggaatgtcaggcctctgagcccaagctaagccatcatatcccctgtgacctgcacatacacatccagatggccggttcctgccttaactgatgacattccaccacaaaagaagtgaaaatggcctgttcctgccttaactgatgacattgtcttgtgaaattccttctcctggctcatcctggctcaaaagctcccctactgagcaccttgtgaccccccactctgcccgccagagaaaacccccctttgactgtaattttcctttacccaaatcctataaaatggccccacccctatctcccttcgctgactctcttttgggactcagcccacctgcacccaggtgaaataaacagctttattgctcacacaaagcctgtttggtggtctcttcacagggatgcgagtgaaa

SEQ ID NO: 145 - DNA, 401 bp, Homo sapiens
gtcaggtctctgagcccaagctaagccaccatatcccctgtgaccggcacgtacacatccagatggccttaactgatgacattccttcacaaaagaagtgaaaatggcctgttcctgccttaactgatgacattcccttgtgaaattccttctccttgctcatcctggctcaaaagctcccctgctgatcaccttgtgacccctgccacctgcccgccagagaacaatcccctttgactataactttcctttacctacccaaatcctataaaacggccccactcctatctcccttccatgactctctttttggactcagcccgcctgcagccaggtgaaataaacaaccttgttgctcacacaaaccctgtttggtggtctcttcacacggacacgagtga

SEQ ID NO: 146 - DNA, 822 bp, Homo sapiens
gagagacaggactagctggatttcctaggccaactaagaatccctaagcctagctgggaaggtgaccacatccacctttaaacatggggtttgcaacttagctcgcacccaaccaatcagagagctcactaaaatgctaattaggcaaaaacaggaggtaaagaaatagccaagcatctattgcctgagagcacagtgggagggacaaggatcgggatataaacccaggcattggagcctgcaacctaaccccctttgggtcccctcccctggtatgggagctttgttttcactctattaaatcttgcaactgcactcttctggtgcgtgtttgttatggctggagctgagctttcgctcactgtccaccactgctgttttgccaccatcgcagacccgccgctgacttccatcactccggatccggtagggtgtctgctgtgctcctgatccagcaaggcgcccattgccactcccgatcgggctaaaggcttgccattgtacctgcccggctaagtgcctgggttggtcctaatcgagctgaacactagtcactgggttccatggttctcttccatgacccacgacttctaatagagctataacactcaccacatggcccaagattccattccttggtatctgtgaggccaagaaccccaggtcagagaacacgagacttgccaccatcttggaagtggcccgccgccattttggaagtggcccaccaccatcttgggagctctgggagcaaggacccccagtaacattttggcaaccacaaagggacatccaaagcggtgagtaatattggaccactct

SEQ ID NO: 147 - DNA, 5785 bp, Homo sapiens
gtcaggcctctgagcccaagcctgcacgtatacatccagatggcctgaagcaaatgaagaatcacaaaagaagtgaacatggctggatcctgccttaactgatgacattaccttgtgaaatgacttctcttggctcagaagctcccccactaagcaccctgtgacctccgcccctgcccaccaaagaacaaccccctttgactaattttccattacctacccaaatcctataaaacagccacaccccatcacccttcgctgactctcttttccaactcagcctgcctgcacccaggtgattaaaaaactttattgctcacacaaagcctgtttagtggtctcttcatatggatgcctgtgaaatttggtgccgtgactcggatctggggacctcccttgggagatcaatcccctgtcctcctgctctttgttctgtgagaaaggtccacttatgaccttgggtcctcagaccaaccagcccaagaaatatctcaccgattttaaatcgggtaagtggcctctctttactctcttctccaacctctctcactatccctcaacttctttttcctttcagtcttggcgccatccttcaatctctctcttctcttaatttcagttcctttccttttctggtagagacagaggagacgcgttttatccgtgaacccaaaactccagtgccggtcacgaactcaggaaaactgtcttcccttggtgtttaatcacttaatcactgtggggacgcctgcttgattactcacccacatttcagtggtgtctgatcactacggggatgcctgccttgatccttcacccttggggcaagcaccccccaccctttctctccatgtctctaccctctcttttctctccactttcctggggggggcaagcaccccccaccccttctctccgtgtctctatcctctcttttctctgggcttgcctccttcactatgggtaaccttctaccctccattcctccctcttctcccttagcctgggttcccaaaaacgtaaaacctgaactcacacctgacctaaaacctaaacaccctattttcttctgcaatgccacttaaccacaaaacaaacttgacaatggttccaaatagtcagaaaatgacactttcaatttttccatcctacaagatctagataattcttgtcataaaatggacaaatggtctgaggtgcctgacatctaggcatccttttacacatcagtccctccctagtctctgctctgaatgcaactcatcccaaatcttccttctttccctccctcctgtaccctcagttccaacctcaagtgttgctgagtcttttcaatcttcccttttcaccgacccatctgaactctccccttctccccagactgcttctcctcaggttgctccgtgccaggctgaatcaggctccaattcttcctcagcctccactaccccaccctgtaatccttctatcacctcccctcctcacacacggtctggcttacagttttgttccacaactagccctcccccacctgcccagcaatttccttttaaaaaggtggctagagctaaaggcattagtcaaggttaatgctcctttttcttcatctctctctttgacctctctcaaatcagttagcgtgtaggctctttttcatcaaatataaaaacccagcccagttcatggcccatttggcaacaaccgttagacgctttatagccctagaccctgaagggtcagaaggctgtcttattctcaatatgcattttattacccaatccgctcccaactttaagtaaagctccaaaaattaaattctggcccccaaaccccacaacaggacttaattaacctcgccttcaaggtgtacgataatagagaagagttgcaattatgtgcctctgctgtgagagaaaccccagccacatctccagcacaaaagaacttcaaaacacctaagccacagtggtcaggcattccttcaggacttcctcccccaagatcttgcttcaagtgctggaaatctggctactgggccaaggaatgcccgcagcccaggattcctcctaagctgtgtcccatctgtgtgggaccccagtggaaattggactgtccaactggcccaaggctctgactgactccttctcagatcttctcggcttagcggctgaagtctgacgctgcccgatcacctcagaagcctcctggacaatcacagatgctttgggtaactcttacagtggagggtaagtctgtccccttcttaatcaatacagaggctacccactccacattaccttcttttcaagggcctgtttcccctccctccataacagttgtgggtattgacggccaggcttctaaacctcttaaaactccccaactctggtgccaacttggacaatattcttttatgcactcctttttagttatccccacctgtccggttcccttattaggctgagacactttaactaaattatctgcttccctgactattcctaggctacagccacacctcattgccacccttttccccagttcaaagcctccttcacatcctccccttgtatctccccaccttaatccacaagtataggacacctctactccctccttggtgacccatcatgcaccccttaccatcccattaaaacctaatccccattcaatgccaatatcccatcccacagcacagtttaaaaggattaaagcctgttatcacttgcctgttacagcaaggccttttaaaggctataaactctccttacaatttcctcattttacctgtcctaaaaccagacaagccttacaggttagttcaggatctgcgccttatcaaccaaattgttttgtctatccaccccatcgtgccaaacccatatactctcctatcctcgatacctccctccacaacccatctgttctagataaacctagctgaccccataaatcctaaatcctttcctcattcacctttccattccttaaaaaacagccctaaaagctgctcccatactagctctccctaactcatcccaacctttttcttttttatttcttttcttttctttttttttgagaaggagtctcactctgttgcccaggctggagtgcagtggcgtgatctcggctcactgcaagttccgcctcctgggttcacaccattctcctgcctcagcctccccagcagctaggactataggtgcacaccaccacacccagctaatttttgtatttttagtggagacggggtttcactgtattagccaggatggtcccaatctcctgaccttgtgatctgcccccgccttgggctcccaaagtactgggattacaggcgtgagccaacgcacctgaccatcccaacctttttcattacacacagccaaagtgcagggctgtggggtcaaaattcttacacaaggaccgggaccgctccctgtggccttttaatccaaacaacttgaccctactgttttagcctagccctcatgtctgtgtgcggcggctgccgctgccttaatacttttagaggccctcaaaatcacaaagtatgctcaactcactttctacagttctcatttcttccaaaatctattttcttcctcacacctgacacatacactttctgctccccagctccttcagctatactcactctttattgagtctcccacaattaccattgttcctggcccagacttcaatccagcctcccatattattctggataccacacctgacccccatgactgtatctctctaatccacctgacattcactccatttcctcttatttccttctttcctgttcctcaccctgatcacacttggtttattgatggcagttccaccaggcttaatcgttgctcaccggcaaaggcaggctatgctatagtatcttccacatctgtcattgaggctaccagtctgccccactgcactacctctcagcaagccgaacacattgccttaacttgagccctcactcttgcaaagggatgacgtgtcaatatttacactgactaaatatgccttccttatcctgcacaccatgctgttacatgggctgaaaaaggttttctccgtaagtaagggtcctccatcattaatgcctctttaataaaaattcttctcaaggccactttacttccaaagaaagctggagtcattcactgcaagggccatcaaaaggcatcagatcccatccctcagggcaatgcttatgctgagaaggtagctaaaaaccagctagacttccaacttcagtccctcacggccagtttttctcctttttatgggtcactcccacctactctcccactgaaacttccacctatcaatctcttcccacacaaagcaaatggttcttggaccaaggaaaatatctccttccagcctcataggcccattctgttctgtcatcatttcataacatcttccatgtaggttacaagccactagcctgtctcttagaacctctcatttcttttccatcatggaaatctatcctcaaggaaatcagttctcagtgttccatctgctattctactaatcctcagggagtgttcaggccccctcccttccctacacaccaagctcggagatttgcccctgcccaggactggcaaattgactttacttacatgccccagtcaggaaactaaaatacctcttggtctggatagacactttcgctttataggtagaggcctttcccacagggtctgaaaaggccaccacagtcattgcttcccttctgttagacataattccttggtttggccttcccacttctatacaatccaataatggaccggcctttattagtcaaatcacccaagcagtttttcaggctcttggtattcagtggaatcttcataccccttaccatcttcaatcttcaggaaaggtagaacagactaatggtcttttaaaaacacacctcaccaaactcagcctctaacttaaaaaggaggactctatcaaggatagagctccaaaattcaccgaccaagcaagtaataacgctgaacccccttgggcacgctctaattggatgtcctgggtcctcccaattcttagtcctttaatatctgtttttctccttctcttatttggaccttgtgtcttccatttcatttttcaattcatacaaaaccgcatccaggccatcaccaatcattctatacaagaaacgctccttctaacaaccccacaatatcacaccttcccacaaaatcttccttcagcttaatctctcccactctaggttcccatgccacccctaatcccactcaaagcagccctgagaaacatcccgattatctctccataccaccccccaaaaattttcgctgccccaacatttcaatactattttattttatttttcttattaatataagaagacaggaatgtcaggcctctgagcccaagcctgcacttgtacaaccagatggcctgaagcaagtgaagaatcacaaaagaagtgaaaatggctggttcctgccttaactgatgacattaccttgtgaaattccttctggctcagaagctcccccactgagtaccttgtgacccccgcccctgtccgccaaagaacaacccccttagactgtaattttccattacctacccaaatcctataaaacagccccacccctatctcccttcactgactctcttttcagattcagcccgcctgcacccaggtgattaaaaagctttattgctcacacgaagcctgtttggtggtctctccacttggacgcgtatgaaa

SEQ ID NO: 148 - DNA, 3505 bp, Homo sapiens
gtcaggcctctgagcccaagccaagccatcacatcccctgtgacttgcacgtatacacccagatggcctgaagtaactgaagaatcacaaaagaagtgaatacgccctgccccaccttaactgatgacattccaccacaaaagaagtgtaaatggctggtccttgccttaactgatgatattaccttgtgaaaatccttttcctgcctcatcctggctcaaaaagcacccccactgaacaccttgcgacccccactcctgcccaccagagaacaaaccccctttgactgtaattttcctttacctacccaaatcctgtaaaacagccccacccttatctcccttccctgactctcttttcggactcagccccccagcacccaggtgaaataaacagccatgttgctcacacaaaacctgtttggtggtctcttcacgcagacacacatgaaatttggtgccgttttttgttgctcacacaaagcctgtttggtggtctcttcacaggggcgcgcatgaaatttggtgccgaaacatctggttgtcaaaataacctcatgtgctggctactacagatatttctaacctcattttacaaacttaaggaacttagccccagagatgttgatctgtctctgttttttttttttcattcactgaacaaatacttactgaaaacctactaagtgccgtatgttgccctaagaattgtagggtgacaaaccatcccagcttgcccagaactagggagattcctgggatgcagatttttcgtgctaaaacgggactgtcctgagcaaactgggatggttgatcagcttaactcaatctggccaccctaacagcacatcacagttcaagtcacaaaataaaccataccagatggagagctctgtctctctctctctttcattatttttgcctcacttgggacttttatttctagaccctactcccagcattagactaaaagttctccttaatgttgccagtgatcacccaagcacgaaaaatactttgctgcccacttatctgcaaaatttgacattctgaccacctgatactctctttggcctttactctttcccttgcttttctctctctttcataatgcccaacatcttcccatctaaactttcatcattaagtgcatggcacccaaatgtatacccatagctgcaatgtgatggctttgacatgtggatgtgtatgactaaaaggtatctccttaactcctggctatcccaagtattcaaataaactaaatctcaacaaaaatgttgttttctccacccccaattcttcctcagcctctgctccttcaccttataatccttctaccacctcccctcctcacacccggtctggcttacagtttagttccgcgactagctcttccccacctgcccaacaatttcctcttagagaggtggctggagctgaaggcacagtcagggcacatgtacctttttctctatcagacctctctcagatcagtcaatgtttaggctctttctcatcagaccccactaaatatatacaggaattccaatatctaactctgtcctacaacttaacctggagtgacttaaatgtcatcctgacgtctaccctctcctcagatgcacgggaaagaattttttctctggcccaatctcatgctgataactgctggcttcatgagccagacctccaggaaggcattagagcagttccccgagaggatccccaatggaactaccaggcaaattccccaggtatagctaggcgatattacatgttttcctgcctagtcgtagggcttaaaaaagcagcttacaaagctgttaattgtgacaaacttaaagaaactacccaaggtaaagatgaaaacccagcccggttcatggcccgcttagcggcaacccttagacgctttaccgccctagacccagaggggccagaaggccgccttattcttaacatgcattttatcacccaatccactcctgacattaggaaaaaacttcaaaaactagaatctggccctcaaaccccacaacaggaattaatcaacctcaccttcaaggtgtacaataatagagaggaagcagccagacggcaacgcgtttctgagttacaattacttgcctctgctgtgagagaaaacccagccacacctcctgcatatgagaacttcaaaatgcctaagccgcagcagtcaagcattcctacaagacttcctccaacaggatcttgcttcaagtgccagaaatctggccactgggccaaggaatgcccgtagcctgggattcctcccaagccatgtcccatctgtgcagggacccactggaaatcagactgcccagctcacctggcagccattcctagagcccctaaagctctagcccaaggctctctgattccttcccagatcttcttggcttagcagctgaagactgacactgcccgattgcctcggaagcaccctacaccatcaaggacaccgagcttcaggtaactctcacagtggaaggtaagcccatccccttcttaatatggaggctacccactccacattaccttcttttcaagggcctgtttcccttgcctccataactgttgtgggtattgatggccaggcttctaaacctcttaaaactccccaactctggtgccaacttagacaataatcttttaagcactcctttttagttatccccatctgcccagttcccttattagtctgagacactttaactaaattatctgcttccctgactattcctggactacagctgtatctcattgctgcccttcttcccaatccagtctcctttgcgtcctcctcttctatccccccaccttaacccacaagtataagatacctctactccctccttggcgaccgatcatgcaccccttaccatctcattaatacctaatcacccttacctcactcaatgccaatatcccatcccccagcacgctttaaaaagattaaagtctgttatcacttgcctgctacagcatggccttttaaaccctataaactctccttacaattcccccattttacctgtcctaaaaccagacaagccttacaagttagttcaggatctgcaccttatcaaccaaattgttttgcctctccaccccgtggtgcccaacccgtacactcttttgtcctcaataccttcctccacaactcactattccatgcttgatcttaaagatgattttttcactattcccctgcacccctcatcccagcctctctttgctttcacttagactgaccctgagacccattaggctcagcaaattacctaggctgtactgccgcaaggcttcacagacagcccccattacttcagtcaagcccaaattttatcctcacctgttacctatctcggcataattctcataaaaacatacgtgctttccctgctgatcatgtccgattaatctcccaaacctcaatcccttacaaaacaacaactcctttccttcctaggcatagttag

SEQ ID NO: 149 - DNA, 972 bp, Homo sapiens
gtggggaaaagaaagagagatcagattgttactgtgtctgtgtaggaagaagtagacataagagactccattttgttctgtactaagaaaaattcttttgccttgagacgctgttaatctgtaaccctacccccaaccctgtgctccctaagacatgggctgtgtcaactcagggttaaatggattaagggctgttcagggtgtgctttgttaaacaaatgcttgaaggcagcatgcttgttaagagtcatcaccactccctaatctcaagtacccagagacacactacactgcggaagactgcagggacctctgcctaggaaagccaggtattgtccaaggtttctccccatgtcatagtctgaaatacagcctcatgggaagggaaagacctgactgtcccccagcccgacacccgtaaagggtctgtgctgaggaggattagtaaaagaggaaggaaggcctctttgcagttgagataagaggaaggcatctgtctcctgctcatccctgggcaatggaatgtctcggtgtaaagcccgattgtatattccatctactgagataggagaaaaccgccttaggactggaggtgggacatgctggcagcaatactgctctttaaggcattgagatgtttatgtatatgcacatcaaaagcacagcacttttttctttaccttgtttatgatgcagagacatttgttcacgtgtttacctgctgatcttctctccactattatcctattgtcctgccacatccccctctccggaaacgcccaataatgatcaataaatactaagggaactcagaggccagtgcaggcatgggtcctccgtatgctgaacgccagtcccctgggcccatttttctttctctgtactttgtctctgtgtctctttcttttccaagtctctccttccacctaacgagaaacgcccacaggtgtggaggggcaacccatcccttca

SEQ ID NO: 150 - DNA, 398 bp, Homo sapiens
gtcaggcctctgagcccaagctaagccatcacatcccctgtgacctgcacgtatacatctagatggcctgaagtaactgaagaatcacaaaagaagtgaaaatggcctgttcctgccttaactgatgacattaccttgtgaaattccttctcctggctcatcctggctcaaaagctccccggctgaacaccttgtgacccccacccctgccagccagagaacaaccccctttgactgtaattttccactacctacccaaatcctataaaacggccccacccctatctcccttcactgactctttttggactcagcccgcctgcacccaggtgaaataaacagccttgttgctcacacaaagcctgtttggtggtctcttcacacggacgcgagtgaaa

SEQ ID NO: 151 - DNA, 413 bp, Homo sapiens
gtcagacctctgagcccaagctaagccatcatatcccctgtgacctgcaggtacacatccagatggccagttcctgccttaactgatgacattccaccacaaaagaagtgaaaatggcctgttcctgccttaaccgatgacattatcttgtgaaattccttctcctggctcatcctggctcaaaagctcccctactgagcaccttgtgaccccaacacctgcccgccagagaacaacccccctttgactgtaattttcctttacctatccaaatcctataaaacttccctacccctatctcccttcgctgactctcttttcggactcagcccgcctgcacccaggtgaaataaacagccttgttgctcacacaaagcctgtttggtggtctcatctcacggacgtgcatgaaa

SEQ ID NO: 152 - DNA, 972 bp, Homo sapiens; identical to SEQ ID NO: 149

SEQ ID NO: 153 - DNA, 5841 bp, Homo sapiens
gtcaggcctctgagcccaagcccagccatcgcatcccctgtgacttgcacatatatgcccagatggcctgaagtaactgaagaatcacaaaagaagtgaatatgccctgccgcaccttaactgatgacattccaccacaaaagaagtgtaaacggccggtccttgtcttaagtgatgacattaccttgtgaaagtccttttccgagctcatcctggctcaaaaagcacccccactgagcaccttgggacccccgcccctgcccaccagagaacaaccccctttgactgtaattttcctttaccttcccaaatcctataaaacggccgcacccctatctcccttggctgactctcatttcggactcagcccgcctgcacccaggtgaaataaacagccatgttgctcacacaaagcctgtttggtggtctcttcacacggacacgcatgaaatttggtgccatgactcgaattgggggacctcccttgggagatcaatcccctgtactgctgttctttgctccatgagaaagatccacctacgacctcaggtcctcagaccgaccagcccaaggaacatctcaccaattttaaatcaggttagcggcctcttcttactctcttctccagcctctctctgtccctcaaccacactttctcctttccactcttcaatctctcccttctcttaatttcaattcctttcattttctgagacagacaaaggagacacgttttatccgtggacacaaaactctggcgccggtcacggactgggaaggcagctttcccttggtgtttaatcattgcagggacacctctctgattatacacccacgtttcaagggtgtcagaccacgcagggacgcctgccttggtccttcacccttagcggcaagtcccacttttctggggaaggtgcaagtacctcaaccccttctctccttgtccctacccattctctgcttttccggggacagggcaagtaccccaaccccttctctccttgtctctacccttctctgcttttctgggagaggggcaagtacctcaaccccttctctccgtgtctctaccccttctctgctttcctggggcaggggtaagtacccctcaaccccttctccttcacccttagcggcaaatcccactttcctagggggaaagaaccccccaatcgcttatttccgcaccccaacctcttatctctgcaccccaataccttatttccgcaccctgacctcttatctctgtgcctcaatcccttatttccgtgccccaaccccttctctgcttttctggagggcaggaacccctcaccccttctccgtgtctctactcttttctctgggcttgcctccttcactataggtaagcttccaccttccattcctccttcttctcccttggcctgtgttctcaaaaacttaaaatctcttcaactcacacctgacctaaaacctaaatgccttattttcttctgcaatgccgcttgaccccaatacaaactcgacagtagttccaaatagccagaaaatggcactttcaatttttccatcctacaagatctaaataattcttgtcataaaatgggcaaatggtctgaggtgcctgacgtccaggcattcttttacacatcagtcccttcctagtctctgtgtccagtgcaactcatcccaaatcttccttctttccattctgcctgtccccttagtcccaaccccaagcgtcactgagtctttctaatcttccttttctacagacccatctgacctcttccctcctcgccagcccaagctacgtcccaattcttcctcagcctccgctcctccaccctataatctttttatcacctcccctcctcacacctggtccggcttacagtttcgttccgtgactagccctcccccacctgcccagcaatttactcttaaaaaggtggctggagccaaagacatagtcaaggttaatgctcctttttctttatcccaaatcagatagcatttaggctttttcatcaaatataaaaacccagcccagttaatggctcgttcggcagcaaccctgagacactttacagccctagaccctaaaaggtcaaaaggccgtcttattctcaaaatacattttattacccaatctgctcccaacatcaaataaaacaccaaaaattaaattctggccctcaaaccccacaacaggatttaattaacctcatcttcaaggtgtacaataacagaaaaaagttgcaattccttgcctccactgtgagacaaaccccagccacatctccagcacacaagaacttccaaatgcctgacccacagcggccaggcattcctccagaacctcctcccccaggagcttgctacatgtgccggaaatctggccactgggccaaggaatgcccgcagcccgggattcctcctaagccgcgtcccctctgtgtgggaccccactgaaaatcggactgttcaactcacctgacagccactcccagagcccctggaactctggcccaaggctctctgactccttcccagatcttctcagcttagcggctgaagactgacactgcccgatcccctcggaagccccctaaaccatcatggacgccgagcttggggtaactctcacagtggaaggtaagcccgtccccttcttaatcaatacggaggctacccactccatattaccttcttttcaagggcctgtttcccttgcctccataactgttgtgggtattcacggccaggcttctaaacctcttgaaactccccaactctggtgctaacttggacaatactcttttaagcactcctttttagttatccccacctgcccagttcccttattaggctgagacactttaaattatctgcttccctgactattcctagactacagctatatctcatggccgccctttttcccaatccaaagcctcctttgcgtcctcctcttgtatccccccaccttaacccacaagtataagatacctctactccctccttggagaccgatcatgcaccccttaccatctcattaaaacctaatcacccttaccccactcaacaccaatatcccatcccacagcaggctttaaaaagattaaagcctgttatcactcgcctgctacagcatggtgttttaaagcctataaactctccttataattcccccattttacctgtcctaaaaccagacaagccttacaatttagttcaggatctgcaccttatcaaccaaattgttttgcctatccaccccgtggtgccaaacccatatactctcctatcctcaatacctgcctctacaacccattattctgttctggatctcaaacatgctttctttactattcctttgcatccttaatcccagcctctcttcgctttcacttggactgaccctgacacccatcaagctcagcaaattacctaggctgcactgccgcaaagcttcacaaacagcccccattacttcaatcaagcccaaatttcttcctcatctgttacctatctcggcataattctcataaaaacacatgtgctctccctgccaatcgtgtccaactgatctctcaaaccccagcaccttctacaaaaccacaactcctttccatcctaagcatggttagctcggtcagaattcttacacaagagccaggaccacaccctgtagcctttctgtccaaacaacttgaccttactgttttagcctagccctcatgtctgcgtgcagcagctgccactgctttaatacttttagaggccctcaaaatcacaaactgtgttcaactcactctctgcagttctcataacttccaaaatctattttcttcctcatacctgacgcatatactttctgcttcccggctccttcagctgtactcactgtttgttgagtctcccacaattaccattgttcctggcccatacttcaatccagcctcccacattattcctgataccacacctgacccccatgaccgtatctctctgatccacctgacattcacatttccccaaatttccttctttcctgttcctcaccctgatcacgcttgatttattgatggcggttccaccaggcctaatcgccacacaccagcaaaggcaggttatgctatagtacaagccactagcccgcctcttagaacctctcatttcctttccattgtggaaatctatcctcaaggaaataacttctcagtgttccatctgctattctactactcctcagggattattcaggccccctcccttccctacacatcaagctcgaggatttgccccacccaggactggcaaattagctttactcaacatgccccgagtcggataactaaaatacctcttagtctaggtagacactttcactggataggtagaggcctttcctacagggtctgagaaggccaccacagtcatttctacccttctgtcagacataattcctcagtttagccttcccatctcaatacagtctgataacagaccagcctttattagtcaaatcagccagcagtttttcaggctcttagtattcagtgaaacctttatatccctcacggtcctgcgtcttcaagaaaagtagaatagactaaaggtcttttaaaaacacacctcaccaagctcagccaccaacttaaaaaggactggacaatacttttaccactttcccttctcagaattcaggcctgtcctcagaatgctacagggtacagcccatttaagctcctgtatagacgctcctttttattaggccccagtctcattccagacaccagaccgactttgactgtgccccaaaaaaaattgtcatccctactatcttctgtctagtcatactcctattcaccgttctcaactactcatacatgccttgctcttgtttacactgccggtttacactgtttctccaagccatcacagctgatatctcctcctgctatccccaaactgccactcttaactcttgaagtaaataaataatctttgctggcaggactatgctgaatctccttaggcactctctaatcagatatcctgagtcatcccaattcttagaacttttatacctgtttttctccttctgttattccatttagtttttcaattcatccaaaaccgtatccaggccatcaccaatcattctatacgacaaatgtttcttctaacatccccacaatatcaccccttaccacaagacctcccttcagcttaatctctcccactctaggttcccacactgcccctaatcccgcttgaagcagctctgacaaacatcgcccattctctctccataccactccctaaaaattttcgctgccccaacacttcaacactattttgttttatttttcttattaatgtaagaagtcaggaatgtcaggcctctgagcccaagccaagccatcgcatcccctgtgacttgcacgtataagccccgatggcctgaagtaactgaagaatcacaaaagaagtgaatatgccctgccccaccttaactgatgacattccaccacaaaagaagtgtaaatggccgttccttgccttaagtgatgacattaccttgtgaaagtccttttcctagctcatcctggctcaaaaagctcccccactgagcaccttgggacccttgcccctgcccaccagagaacaaccccctttgactgtaattttcctttaccttcccaaatcctataaaatggccccacccctatctcccttggctgactctcatttcggactcagcccgcctgcatccaggtgaaataaacagccatgttgctcacacaaagcctgtttggtggtctcttcacacggacgcgcatgaaa

SEQ ID NO: 154 - DNA, 711 bp, Homo sapiens
gagagacaggactagctggatttcctaggctgactaagaattcctaagcctagctggggaaggtgactgcacccacctttaaacacggggcttgtaactcagctcacacctgaccaatcaggtagtaaagagagctcactaaaataccaattaggccaaaagcaggaagtaaagagtcaaacatctatcacctgagagcacagagggagggacaatgatcaggatatataaacccaggcattggagccagcagtggcaaccccctttgagtccccttccgttgtatgggagctctgttttcactctattaaatctcgcaactgcacgctcttctggtccgtgtttgttccggctccagctgagctttcgctcgccgtccaccactgctgatcactgctgtcgcagaccctccactgacttccatccctctggatccagcagggtgtccactgtgcttctgatccagcgaggcgcccactgccgctcccaattgggctagaagctcgctattgtttctgcacggctaagtgcccgggttctgtcctaatcaagctgaacactagtcgcagggttccacggttctcttccatgacccacagcttctaatagagctataacactcactgcatggcccacagttccattccttggaatctgtgaggccaagaaccccaggtcagaggacaaaaggcttgccaccatcttgggagc

SEQ ID NO: 155 - DNA, 354 bp, Homo sapiens
ccacaaaaaaagtgaaaatagccagttcctgccttaactgatgacattccaccattgtgatttgttcctgctccaccctaactgatcaattgaccttgtgacattccttctcctggacaatgagtctcagaatctccccactgagcactttgtgacccttgcccctgcccacaagaaaaagaaaccctttaactgtaattttccattacctacccaaatcctataaaactgccccaccccatctccctttgctgacctctttttcagactcagtccgcctgcacccaggttattaaaaagctttattgctcacgcaaagcctgtttggtggtctcttcacatagacacatgtga

SEQ ID NO: 156 - DNA, 3432 bp, Homo sapiens
gtgggggaaagaaatagagatcagactgttactgtgtctatgtagaaagaggaagacataagaaactccattttggggatctaattaaactaaagagcttctgcacagcaaaagaaactatcatcagagcgaataggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaagacacatgaaaaaatgttcaccatcactggccatcagagaaatgcaaatcaaaaccacagtgagataccatctcacaccagttagaatggcgatcattaaaaagtcaggaaacaacaggtgctggagaggatgtggagaaacaggaacacttttacactgttggtgggactgtaaactagttcaaccattgtggaagtcagtgtggcaattcctcatggatctagaactagaaataccatttgacccagccatctcattactgggtatatacccaaaggactataaatcatgctgctatgaagacacatgcacacgtatgtttattgcggcattattcacaatagcaaagtcttggaaccaacccaaatgtccaacaatgatagactcattaagaaaatgtggcacatatacaccatggaatactatgcagccataaaaaatgatgagttcatgtcctttgtagggacatggatgaaactggaaatcatcattctcagtaaactatcgcaagaacaaaaaaaccacacaccgcatattctcactcataagtgggaattgaacaatgagagcacatggacacaggaaggggaacatcacactctggggactgttgtggggtggggggaggggggagggatagcactgggagatatacctaatgctagatgatgagttggtgggtgcagcgcaccagcatggcagatgtatacatatgtaactaacctgcacattgtgcacgtgtaccctaaaacttaaaagtataataataaaaaataaataaataaataaaagaaactccattttgatctgtactaagaaaaattctgctgccttgtgttgtgggaagtcagggaccccaaatggggggactggctgaagctatgacagaagaacatggattgtgaagattttatggacatttattagttccccaaattaatacttttgtaatttcttatgcctgtctttactgcaatctctaaacataaattgtaaagatttcatggacacttatcacttccccagtcaatacccttgtgatttcctatgcctgtctttactttatttttttattttttatttatttttttttttgagagggagtctcgctctgttgcccaggctggagtgcagtggcacaatctcggctcactgcaagctccgcctcccgggttcaggccattctcttgccttagcctcctgagcagctgggactacaggcgcccgcaaccatgcccagctaattttttgtatttttagtagagacggggtttcaccgtgttcaccaggatggtctcgatctcctgacctcgtgatccacccacctcggcctctgaaagtgctgggattacaggcgtgagccactgcgcccggccaacctgtctttactttaatctcttaatcctgtcagtcgaggaggatgtatgtcacctcaggaccctgtaataattgcattaactgcacaaattgtagagcatgtgtgtttaaacaatatgaaatctgggcaccttgaaaaaagaacaagataacaacaatgtttaggaaacaagagagataaccttaaactctgaccactggtgagccgggcagaacagagccatatttctcctctttcaaaagaaatgggagaaatatcgctgaattctttttctcagcacggaacgtccctgaggaagagaatacacgcctggaggtataggcttataaacagcacccccaggtgcgcctgtctcttatggtcgaaattgcagagatgaaatatactccagtctcccatagcgctcccaggcttattagaaagaggaaattcctgcctaataaattttggtcagaccaattgatctcaacaccctgtctcctgataagatgttaccaatgacaatagtgcccgaaacttcattagcaattttaatttcgcctcagtcctgtggtcctgtaatctcaccctgcctccacttgccttgtgatattctattaccctgttaagtatttgatgtctgtcacccacacctattcgcacactccctccccttttgaaaagccctaataaaaacttgctggtttttgtggcttgtggggcatcacggatcctaccaacgtgtgatgtctaccccggacgcccagctttaaaatttctcttttgtactctgtccctttatttctcaagccggccgacgcttaggaaaaatagaaaagaacctacatgattatcggggcaggtcccccgaaagccttgagatgctgttaatctgtaaccctatcctcaaccctgtgctcgcagaaacatgtgctatattgactcaaggtttaatggatttagggctgtgcaggatgtgccttggtaaaaatgtgtttgcaggcagtgtgcttggtaaaagtcatcgccattctccagtcttgagtacccagggacacaatgcactgcggaaggccgcagggacctctgcccaagaaagcctgggtattgtccaaggtttccccccactgagacagcctgagatatggcctcgtgggaagggaaagacctgaccgtcccccagcccgacacccgtaaagggtctgtgctgaggaggatcagtgaaaaaggaaggcctctttgcagttgagataagaggaaagcatctgtctcctgctcatccctgggaatggaatgtttcggtgtaaaacccgattgatcgtacattcgatttactgagataggagaaaaccgccttatggctggagatgagacgtgctggcggcagtactgctctttactgcactgagatgtttgcgtgaagtcaaacgtaaatctggcctatgtgcacatcgaggcacagcacctttccttaaacttgtttatgacacagagtcctttgctcacgttttcctgctgaccctctacccaccattaccctatagtcctgccacatccccctcgccgagatggtagagatagtgatcaataaatactgagggaactcagagaccagtgctggtgcaggcccttgcttgctgagcgctggtcccctgggcccacttttattcctctatactttgtctctgtgtcttatttgttttctcagtctctcatctccaccttgcgagaaatacccacaggtgtggaggggcaggccccc

SEQ ID NO: 157 - DNA, 118 bp, Homo sapiens
tgggacaacagttatcagctcaatggcaacagtatataaaagtattgaaacagctgcttaaagctagcggagccttggttttgcaggctcaattaagggacctaatgcaaactgttgt

SEQ ID NO: 158 - DNA, 2385 bp, Homo sapiens
ctataaaagaagtgaaaatagtcagttcctgccttaactgatgacattccaccattgtgatttgttactgccccacctgaactgatcaattggccttgtcacattccttctcctggacagtgaatctcaggagctccccactgagcaccttgtgacccccgcccctgtccacaagagaacaaccccttttaagtctaattttccactacctacccaaatcctataaaactgtcccacccctatctccctttgctgactccttttttttggattcagcttgcctgcacccaggtgattaaaaagtttattgctcacacaaagcctgtttggtggtctcttcacatggacatgcataacatttggtgccaaagacctgggacaggggactccttcaggagactcatcccgggtcctcaccctcactccgtgaggagatcacctatgaccttgggtcctcagaccagccaaaggaacatctcaccaattttaaatcaggtaagtggcctctttttgttctcttctccagcctgtcttgttagccctccacccttcaatctctcccttccttaattttggttcctttccttttctggtagagacagaggagacacgttttatccatgaactcaaaactccggcaacagtcatggacttgggaagacagtcttcccttggtgtttaatcactgtggggatgcctgccttgatccttcaccttggtggcaagtaccaccttccctgggtggcaagaccacctccccccacactgtgtctctatcctctcttttctctaaactcaccttttaactatgggcaaacttccaccctccattcctccttcttctcccttaccctgtgttctcaagaacttacacctcttcaactcacacctgacctaaaacctaaatgccttattttcttctgcaatactgcttggccccaatacaaacttgacaatggttctaaatgaccagaaaatggcacttttgatttctccatcctacaagatctagataatttttgtcgaaaaatgggcaaatggtctgaggtgcttgacatccgggcattcttttacacattggtccctccctagtctctgctcccaatgcaacttgtcccaaatctttcttccttctctcctgtctgttccttcagtttccaccccaagctctgagtcctttgaatcctccttttctacaaacccatctgacctctcccagcctccccaggctgctcttcaccaggccgagcaaggtcccaattcttcctcagcctctgctccctcaccctataatccttctatcacttcccctcctcacacctgttccagcttacagtttcgttctgtgactagctctccccaacctgcccaacaatttcctcttagagaggtggctggagctaaaggcatagtcaaggttaatgctcctttttctttatccagcctctcccaaatcagttagcatttagtctctttttcatcaaatataaaaacctagtccagttaatggcctgtttggcaagaacccttagatgctttaccgctctagacccagaggggccagaaggccgtcttattctcaatatgcattttattacccaatctgctcccaacgttagaaaaaactccaaaaattatattccgggcctcaagccccacaataggacttaattaacctctccttcaaggtgtacaataatagagaagaggcagccaagcagcaatgtatttctgagttacaattacttgcctctgctgtgtgagagagaaaccccagccacatctccagcacaaaagaacttcaaaacatctaaaccacagtggccaggcattcctccaggacctcctcccccaggatcttgcttcaaatgctggaaatctggccactgggctaaagaatgcccagcctgggattcctcctaagccatgtcccatctgtgtgggaacccactggaaccagctcacccggcagccactcccagagcccctggaactctggcccaaggctctctgactgactccttcccagatcttctcggcttagcggctgaagactgacgctgcctgatcacctcagaagcctcctggaccatcacagatgctttgggtaactcttacagtggagggtaagtccacctccttcttaatcaatatggaggctacccactccacattaccttcttttcaagggcctgtttcccttgcctccataactgttgtaggtattgatgaccaggcttctaagcctcttaaaactccccaactctggtgccaacttggacaacattcttttatgcactccttttcagttatccccacctgcccagctcccttattaggtcgagacattttaactaaattttctgcttccctgactattcccgg

SEQ ID NO: 159 - DNA, 5540 bp, Homo sapiens
gtcaggcctctgagcccaagccaagccatcgcatcccctgtgacttgcacgtatacgcccagatggcctgaagtaactgaagaatcacaaaagaagtgaatatgccctgccccaccttaactgatgacattccaccacaaaagacgtgtaaatggccggtccttgccttaactgatgacattaccttgtgaaagtccttttcctggctcatcctggctcaaaaagcacccccactgagcaccttgcgacccctactcctgcccgccagaaaacaaaccccctttgactgtaattttcctttacctacccaaatcctataaaacagccccacccttatctcccttcgctgactcttttttcagactcagcccgcctgcacccaggtgaaataaacagccatgttgctcacacaaagcctgtttggtggtctcttcacaccgacgcgcatgaaatttggtgccgtgactcggatcggggacctcccttgggagatcaatcccctgtactcctgtgttctttgctccgtgagaaagatccacctacgacctcaggtcctcagaccgaccagcccaaggaacatctcaccaattttaaatcaggtaagcggcctcttcttactctcttctccaacctctctcactgtccctcaaccactttctcctttccactcttcaatctctcccttctcttaatttcaattcctttcattttctgggagagacaaaggagacacgttttatccatggacccaaaactccggcgccggtcacggactgggaaggcagccttcccttggtgtttaatcattgcagggacgcctctctgattatacacccacgtttcaagggtgtcagaccatgcagggacgcctgccttggtccttcacctttagcggcaagtcctgcttttctggggaaggggcaagtacctcaaccccttctctccttgtctctaccccttctctgcttttctgggagaggggcaagtacccctcaaccccttctccttcacccttagcggcaagttccgcttttctatggggcaagaaccctcaatctcttatttccactccccaacctcttatctctgtgccccaatcccttatttccatgccccgacctcttatctctgcaccccaaccccttttcccacttttctggaaggtaagaacccccgaactccttccctccatttctctactctctcttttctctaggcttgtttccttcactatgggcaaccttccaccctccattcctccttctactcccttggcctgtgttctcaaaaacttaaaacctcttcaactcacacctgacctaaaacctaaatgccttattttcttcggcaatgccacttgaccccaatacaaactcgacagtagttccaaatagccagaaaatggcactttgaatttttccatcctgcaaaatctaaataattattgtcgtaaaataggcaaatggtctgaggtgcctgacgtccaggcattattttacacatcagtcccttcctagtctctgtgcccagtgcaactcgtctcaaatcttctttctttccctcccgcctgtcccctcagtaccaaccccaagcgtcgctgagtctttctaatcttccttttctacagacccatctgacctctcccctcctcgccagcccaagctaggtcccaattcttcctcagcctccgctcctgcaccctgtaatctttttatcgcctcccctcctcacacctggtccggcttacagtttcgttccgtgactagccctcctccacctgcccagcaatttactcttaaaaaggtggctggagccaaaggcatagtcaaggttaatgctcctttttctttatcccaaatcagaagcgtttaggctctttttcatcaaatataaaaacccggcccagttcatggctcgtttggcagcaaccctgagacgctttacagccctagaccctaaaaggtcaaaacgccatcttattctcaatatacattttattacccaatctgctcccgacattaaataaaactccaaaaattggaatctggccctcaaaccccacaacaggacttaattaacctcgccttcaaggtgtacaataacagaaaaaagttgcaattccttgcctccactgtgagacaaaccccagccacatctccagcacacaagaacttccaaatgcccgaaccgcagcggccaggcgttcctccagaacctcctcccacaggagcttgctacacgtgccagaaatctggccactgggccaaggaatgcccgcagcctggcattcctcctaagccgtgtcccatctgtgtaggaccccatgaaaatcagactgttcaactcacctggcagccactcccagagcccctggaactctggcccaaggctctctgactgactccttcccagatcttctcggcttagcggctgaagactgacactgcccgatcgcctcggaagccccctggaccatcacggacgccgagcttcgggtaactctcacagtggaaggtaagcccgtccccttcttaatcaatacggaggctacccactccacattaccttcttttcaagggcctgtttcccttgcctccataactgttgtgggtattgacggccaggcttctaaacctcttaaagctccccaactctggtgccaacttagacaatactcttttaagcactcctttttagttatccccacctgcccagttcccttattaggctgagacactttaactaaattatctgctttcctgactattcctggaccacagctatatctcattgccgcccttcttcccaatccaaagcctcctttgtgtcctcctcttgtatcccccgaccttaacccacaagtataagatacctctactccctccttggtgaccgatcatgcaccccttaccatctcattaaaacctaatcacccttaccccactcaacgccaatatcccatcccgcagcacgctttaaaaagattaaagtctgttatcactcgcctgctacagcatggccttttaaagcctataaactctccttacaattcccccattttacctgtcctaaaaccagacaagccttacaagttagttcaggatctctgccttatcaaccaaattgttttgcctatccaccccgtggtgccaaacccatatactctcctatcctcaatacctgcctctacaacccattattctgttctagatctgaaacatgctttctttactattcctttgcacccttaatcccagcctctcttcgctttcacttggactgaccctgacacccatcaagctcagcaaattacctaggctgtactgccacaaagcttcacaggcagcccccattacttcaatcaagcccaaatttcttcctcatctgttacctatctcggcataattctcataaaaacacacgtgctctccctgccaatcgtgtccgactgatctctcaaaccccagcaccttctacaaaacaacaactcctttccttcctaggcatggttagcgcggtcagaattcttacacaagagccaggaccacaccctgtagcctttctgtccaaacaacttgaccttactgttttagcctagctctcatgtttgcgtgcagtggctgctgctgctttaatacttttagaggccctcaaaatcacaaactatgctcaactcactctttacagttctcataacttccaaaatctgttttcttcctcacacctgacgcatatactttctgcttcctggctccttcagctatactcactctttgttgagtctcccacaattaccattgttcctggcccggacttcaatcaatccagcctcccatattattcctgataccacacctgacccccatgactgtatgtctctgatccacctgacattcaccccatttccccaaatttccttctttcctgttcctcacccagatcacacttgatttattgatggcggttccaccaggcctaatcgccacacaccagcaaaggcaggttatgctatagtacaagccactagcccacctcttagaacctctcaacaacatgcccgagtcaggaaactaaaatacctcttaatctaaatagacactttcactgaataagtaaaggcctttcctacagggtctgagaaggccaccgcagtcatttcttcccttctgtcagacataattcctcaatttagccttcccacctcaatatagtctgataacagacgagcctttattagtcaaatcagccaagcagtttttcaggctcttagtattcagtgaaacctttatatcccttatggtcctccgtcttcaagaaaagtagaatggactaaaggtcttttaaaaacacacctcaccaagctcagccaccaatttaaaaaggactggacaatagttttaccagtttcccttctcagaatacagcccatttaagctcctgtatagacgctcctttttattaggccccagtctcattccagacaccagacgaccaacttagactgtgccccccaccaaaaaaaacttgtcatccctactattttctgtctagtcatactcctattcaccgttctcaactactcatacatgccctgctcttgtttacactgccggtttacactgtttttccaagccatcacagctgatatctcctggtgctatccccaaactgccactcttaactcttgaagtaaataaataatctttgctggcaggactatgccgaatctccttaagcactctctaatcagacatcctgagtcgtcccaattcttagaccttttatacctgtttttctccttctgttattccatttagtttttacaattcatacaaaaccgtatccaggccatcaccaatcattctatacgacaaatgtttcttctaacatccccacaatatcaccccttaccacaagacctgcctccagcttaatctctcccactctaggttcccacaccgcccctaatcccgcttgaagcagccctgagaaacatcgcccattctctctccataccatcccccaaaattttcccaacactttaccattattttgttttatttttcttattaatataagaaggcaggaatgtcaggcctctgagcccaagccaagccatcgcatcccctgtgacttgcacatatatgcccagatggcctgaagtaactgaagaatcacaaaagaagtgaatatgccctgccccgccttaactgatgacattccaccaaaaaagaagtgtaaatggccggtccttgccttaactgatgacattaccttgtgaaagtccttttcctggctcatcctggctcaaaaagcacccccactgggcaccttgcgacccccactcctgcccgccagagaacaaaccccctttgactgtaattttcctttacctacccaaatcctataaaacagccccacccttatctcccttctctgactcttttttcagactcagcccgcctgcacccaggtgaaataaacagccatgttgctcacacaaagcctgtttggtggtctcttcacacggacgcgcatga

SEQ ID NO: 160 - DNA, 293 bp, Homo sapiens
tggatcaggcacaaactaagcccaccccactaggaactatgctgaacaatttcaagaaaggatttaagggagattacagtgttactatgacaccaggaaaacttagaactttgtgtgaaatagactggccagcattagaggtgggttggccatcagaaggaagcctggacaggtcctttgtttcaaaggtatggcacaaggtaagccagggcacccagaccagttcctgtacatagacacttggttacagctggttttagatgccccccacagtggttgagagaacagcagca

SEQ ID NO: 161 - DNA, 401 bp, Homo sapiens
gtcaggcctctgagcccaagctaagtcatcatatcccctgtgacctgcacgtatacatccagatggcctgaagtaactgaagaatctcaaaagaagtgaaaatggcctgttcctgccttaactgatgacattaccttgtgaaattccttctcctggctcatcctggctcaaaagctcccccactgagcacctggtgacccccacccctgcctgccagagaacaaccccctttgactgtaattttcctttacctacccaaatcttataaaacgaccccacccctatctcccttagctgactgtcttttcggactcagcccgcctgcactcaggtgaaataaacagccttgttgctcacacaaaggccagtttggtggtctcttcatacggacatgagtgaaa

SEQ ID NO: 162 - DNA, 1386 bp, Homo sapiens
caggtgggtaactcctcccacatgagtggtctgcctaccctcaggaatattttttgtctgtggtacctcagcctatcattgtttgaatggctcttcagaatctatgtgcttcctctcattcttagtgcctcctatgaccatctacactgaacaagatttatacaatcatgtacctaagccccgcaacaaaagagtacccattcttccttttgttatcagagcaggagtgctaggtgtgctgtgtggcggtatcacaacctctactcagttctactacaaactgtctcaagaactagatttatacaatcatgtacctaagccccgcaacaaaagagtacccattcttccttttgttatcagagcaggagtgctaggtgtgctgtgtggtggtatcacaacctctactcagttctactacaaactgtctcaagaactaaatggtgacatggaatgggtcgccgactccctggtcaccttgcaagattaacttaactccctagcagcagtagtccttcaaaatcgaagagctttagacttgctaaccacggaaagagggggaacctgtttatttttaggggaagaattctgttgttatgttaatcaatctggaattgttaccgagaaatttaaagaaattcaagatcgaatgcaatgtagagcagaggagcttcaaaacactggaccctggggcctcctcagccaatggatgccctgaattctccccttcttaggacctctagcagctataatattgttactcctctttggaccctgtatcttttatttccttgttaagtttgtctcttccagaattgaagctgtaaagctgcaaatcgttcttaaattggagccccagatgcagtccatgactaaaatctaccaaggacccttggactggcctgctagcccatgctccgtgttaatgacattgaaggcacccctcccaaggaaatctcaactgcacaacccctattatgccccaattcagcaggaagcagttagagcggtcgtcgaccaacctccccaacagcacttgggttttcctgttgagaggggttactgagagacaggactagctggatttcctagactgactaagaatccctaagcctagctgggaaggtgaccacatccacctttaaacatggggcttgcaacttagctcacacccaaccaatcaggtaataaagagacctcactaaaatgctaactaggcaaaaacaggaagtaaagaaatagccaatcatctattgcctgagagcacagcaggaaggacagtgatcaggatataaacccaggcattcgagccagcaacggctaccctctttgggtcccctccctttgtatgggagctctgttttcactctattaaatcctgcaactgca

SEQ ID NO: 163 - DNA, 7765 bp, Homo sapiens
gggtcagatacaaagtaagcctactccgctaggaactatgttgaaaaattttaagaaaggatttaatggagactttggggaacttagaactttgtgtgaaatagattggccaacattagaagtagggtggccatcagaaggaagcctggacaggtcccttgtttctaaggtatggcacaaggtaactggtaagtcaggacactcagaccagtttccaaacatagacacttggttacagctgatgctaaaccccccactgtggctaagagggcagacagcagcagtgctagtagcaaagtgacagatagccaaggaaggatcccgctccacccgctgagggaaatgaactcctgaagttctgttcgacccaacatcagaagatccattgcaggagatggcaccagtgatcccagtggtgccctctccttaccagggaggcaggctccccacttttgagtccacagtgcttgcgcctccacaagacaaacatatccctaggccacccagagtagacaagagaggaggtgaggactagggagaaacccctcccttggcagctcgtttaagacccaaaacggggacagaaatgcccctgagagagcagcggtatactgggatagatgaggatggtcacgtggtggggaggcgtgtttttgggtaccggcccttcacctctgcccactttctcaactggaaaagcaataccccgtcctgtaccgaaaagccacaagctctgattgatttgctccaaactattatccagacccataaccccacctgggctgattgccaccggttgttcatattcctctttaacacagatgaaaggcggagagtgctccaagcagcaactaagtggctagaggaacatgcaccagctgattaccaaaacccccaagagtatgtaaggacccagttaccaggaacgacccccagtgggacccacatgaaagagaggatatgcaaaggctaaacagagacagggaatctctcttggaaggattaaagaggggagcccagaaggccacaaatgttaacaaagtctctgaggtcattcagagaaaagaagaaagtccagcacaattgtaggagagactgtgtgaggcctatggtatgtatactccctttgatcccagtagccctgaaaatcaaggcatgattaacatggctttagttagtcaaagcgcagaagacattagaagaaaactgcagaaacaggctgagtttgcagggatgaacacatcatagttattagaaatagctaaccaggcgtttgtaaacagggatgaagtaagccgtaaggaaaaccacagagacaatgaacgtcaggcccagcgaaacaccgacctgttagcggcagcaatcagaggggtccccccaaagaggcaagggaaggggggccccgggaaggaaactcagcctggctgtcagagcttgcagcgtaatcagtgtgcttattgtaaagaaataggacattggaaaaacaaatgccctcagctaaaaagaaaaccaggtgacacagagcaggaggccccggacaaggatgaaggggccctgctcaacctggcagaagggttattggactgagggggactgggctcaaggacccccaaagagcctatggtcaggatgacagttaggagtaaagatattgattttcttgtagataccggtgctaaacattcggtagtaaccgccccggtcacccccttatccaaaaagattattgacatcatcggagccacaggagtttcagcaaagcaagctttctgcttgcctcggacttgtgctgtaggaagacataaagtgattcatcagtttttgtacacacctgactgtcccttgcgcttgttgggaagggacttgcttagcaaactgagagccactatctcttttacagagcacggctctttgctgctaaagtcacccagaacgggagtcattgtgacccttacggtcccccgagaggaagaatggagacttttcttaactgtgtggggccaagagataagaccagctctggctaagcggtgccaagagtgtgggcggaagacaaccctccagggtttgcagtcaaccaagcccccgtacttatagaagttaagcctagggcccagccggttaggcaaaaacaggagccggtccccagagaagctcttgaaggtatccaggtccatctcaagcacctaagaagttttggaattagaggtccttgtcagtctccatggaacactcccctcctgcctgttcccaagcctaagaccaaggactactggccggtacaggatttgcgcttggttaatcaggctacagtgactttacatccagcagtacctaacccgtacacattgctggggttgctgccagctgaggacagctgcttcaccttcttggacctgaaagatgctttctttagcatcagattatcccgagagccagaagctgtttgctttcagtgggcagatccagagtcaggtgtcactactcagtacacttggaccgggcttccccaagggttcaagaactcccccaccatcttcggggaggcattgcctcaagacctccagaagtttcccaccagagacctagactgcgtgttgctccagtacgttgatgatcttttgctgggacaccccatggcagtcgggtgcaccaaaggaacagatgctctactccggcacctggaggactgtgggtataagatgtccaagaaaaaagcttagatctgccgacagcaggtacattacttaggatttactatccgaaagtgggagacagcctaggatcagaaagaaacaggtcatttgaaatctactggagcctaagaccagaaggcaggtgagagaattcttatgggctgtggggttttgaagactgtagatcccaaaatttgcagtataagccaagcctttgtatgaggtcacaaagggagggggaacgggaacgttttgaatggggattccagcaacagcaaggctttcatgagttaaaggaaaaacttatgtcagccccagccctggagctacccgatctaacaaagccttttccattgtatgtgtcagagagagaaaagatggcagttggagttttaacccaaactgtggggccctggccgaggccggtggcctacctctctaaacaactagacggggtttctaaaggacggccccgtgtttgagggccttggcagcaactgccctgctagtacaagaagcagataagctgactcttggacagaacctgaacataaaggcctcccgtgctgtggtgattttaatgaatactaaaggacatcattggctaatgaatgctagactcactaagtaataaagtttgctctgtgaaaatccccgtataaccattgaagtttgtaacaccctgaaccccactaccttgctcccagtatcagagagccctgtcgagcatgactgtgtagaagtgttggactcagtttactctagcagacctaacctccaggaccagccttaggcatcagtagactaggaactatacgtggctgggagcatcttcatcaacccacaaggagagagatgtgcaagatatgcggtggtaactctggacactgttgctgaagccagatcgtttccccagggcacttcagctcagaaagctgaactcgttgctttaattcgggccttagaactcagtgaagctaagaatgtcaacatttacactgactctcaatatgccttttcaacccttcaggtgcgtggagcattatataaagaaaagagcctattgaactctgggggaaaagacataaaatatctacaagaaatcttgtaattattaaaagccgtatggagaccccgcaaggtggcagttatgcattgcagaggacaccagcgagcttccaccttggtgggtttagggaattcccgcgctgacttagaggctcgaaaagcaacatctgcccccttccgggcatcagtcacagcccccatgctccctcaagcacctgatcttgtacctacttattctaaagaagaaaaggactttctccaggcagagagaggacaagtgatggaggaaggatgaattcggtaaccggatgggagagtagctgtgccacagctgctaagagctgcagttgtactggctgttcatgaaaccacccatctaggtcaggaatcacttgaaaagttgttaggctggtatttctacatctcgcatttgtcagctcttgccaaaacggtgacgcagtggtgtgttacctgccgacagcataaagcgaggcaaggtccagccgttccgcccggcatacaagcttatggagcagccccctttgaagatctccaggtggacttcacagagatgtcaaagtgtagaggtaacaagtatttactagttcttgggcgtacctactctgggtaggtggaggcttatccaacactaactgagaaagctcgtgaagtaactcgtgtgcttcttcgagatcttattcctagatttggactgcccttacggatcggctcagataacaggccggcatttgtggctgacttagtacagaaggcggcaaagatattagggatcacatggaatctgcatgctgcctactggcctcagagttccggaaaggtggagcaaattaatcaaactatcaaaaatagtttagggaaagtatgtcaggaaacaggattaaaatggctacaggctctccctatggtattatttaaaattagatgtaccacttctaaaagaacaggatattccccttatgaaatattatatcataggccccctcctatattgcggggacttccaggcactccctgagagttaggtgaaattgagttacagcgacagctacaggccttaggaaaaattacacaaacaatctcagcctgggtaaatgagagatgccctgttagcttattctccccagttcaccctttctccccaggtgatcgagtgtggatcaagaactggaacgtagcctctttgtgtccactgtggaaaggaccccagactgtcgttctgagcactcccaccgctgtgaaggtagaaggaatcccagcctggatccaccacagccatgtaaaacctgcagcgcctgaaacctgggaggcaagaccaagcccagacaacccctgcagagtgaccctgaagaagacgacaagccctgctccagtcacacccggaagctgactggtccacgcacggccgaagcctgaggaagctcatcatgagattcatttttcttaaattttggacttatacagtaagggcttcaactgatcttactcaaactggggactgttcccagtgtactcatcaggtcaccgaagtaggacagcaaattaaaacaatctttctgttctatagttattatgaatgtatggaaacaataaaagaaacttgtttgtataatgccactcagtacaaggtatgtagcccgagaaatgaccgacctgatgtgtgttataacccatctgagccccctgcaccaccgtttttgaaataagaataagaactggccttttcctaggtgatacaagtaaaataataactagaacagaagaaaaagaaatccccaagcaaataactttaagatttgatgcttgtgcagccattaatagtaaaaagctagaaataggatgtggttctcttaactgagaaaggagctaaagagtagaaaataaatatgtttgtcatgagtcaggggtttgtaaaaattgtgcctattggccatgtgttatttcggctacttaaaaaaagaacaaaaaggacccggtttatcttcagaagggggaagccaacccctcctgtgctgccggtcactgtaacccactagaactaataattaccaatcccctaggtcaccgttggaaaaagggagaacgtgtaaccctggggatcaataggacagggttaaaccctcaagttgccattttaattagaggggaggtccacaagtgctctcccaaaccagtatttcaaaccttttatgaggagctgaatctgccagcagcagaacttctgaaaaagacaaaaaatttgtttctccaattagcagaaaatgtaattttcttacttaatgttacttcttgttatgtacgtggaggaaccactatcggagacagatggccttgggaagcccgagagttggtgcctactgatccagctcctgatataattccagttcagaaggccgaagctagcaacctctaggtcctaaaaaccccaattattagacaatactgtagagctagagaagggaaagactttatcatccctgtaggaaagcttaattgtataggacagaggttgtataacagcacaacaaagacaattacttagtagggcctaaaccacactgaaaagaatccatttaataaattttctaaattaaaaactgcttaggctcatccagaatctcatcaggactggacggttcccgctggactatactagatatgtaggcacagagcctacattcggttacctaataaatgggcagacagttgtgttgttggcactattaagccatcctttttcttattacccataaaaatgggtgagctcctaggtttccctgtctacgcctcccgagaaaagaaaggcatagttataggaaactggaaagataatgagtggccccctgaaaggatcattcagtattatgggcctgccacatgggcacaagacggctcatggggatactgaacccccatctacatgctcaattggatcatgcagttgcaggccatcttagaaataattactaatgaaactggcagagctttgactgttttagcttggcaagaaacccaaatgaggaatgctatctatcagaatagactggtcttagactacttgctagtagctgaaggaggagtttgtggaaaatttaacttaaccaattgctgcctacacataaatgatcaaggacaggtggttaaaaacatagtcagggacatgacaaaggtggcacatgtgcctgtacaggtttggcacgagattaatcctgagtctttatttgaaaaatggtttccagctataggaggatttaaaaccctcattgtaggtgtattgctagtgataggaacttgcttgctgctcccctgtgtattacccttgttttttcaaatgataagaggttttgtagctactttggttcatcagaaaacttcaacacacgtgtgttatataaatcagtatcgctctatctcacaaatagactcaaaaagtaaagatgagagtgagaactcccactaaaaagtgaaaatgctcaaaggggggaaatatggtatgagaccaccacttctcctgttgtccttcccagtttctccccaacctccccttttccctagtttgtaagacagcaaaaaagggagaaagcaaaaagttggaaaaaacagaagtaaaataaatagctagacgaccttggcgccaccacctggccctggtggttaaaataacaataatattaacccctgaccaaaactacctgtgttatctgtaaattccagacactgtatgagaaagcactgtaaaaactttttgttctgttagctgatgtttgtagcccccagtcacgttcctcacgctcacttgatctattatgactttttcacgtagaccccttagagttgtcagcccttaaaagagctaggaatttctttttcagggagctcggctcttaagacacagtctgccgacgctcccggctgaataaaaaaacctcttccttctttaatccggtgtctgaggagttttgtctgcaactcgtcctgctaca

SEQ ID NO: 164 - DNA, 5665 bp, Homo sapiens
ctgccttaactaatgacattccaccacaaaagaaaatagcctgttcctgccttaactgatggcatcatcttgtgaaattccttctcctggctcatcctgactcaaaagctcccctactgagcaccttgtgacccccactcctgcctgccagagaaccccccctttttcctttacctacccaaatcctataaaacggccccaccccatctcccttcattgactcttttcggactcagcccacctgcacccaggtgaaataaacagctttattgctcacacaaagcctgtttggtggtctcttcacacggatgcaagtgaaatttggtgccatgactcggatagggggacctcctttgggagatcaatcccctgtcctcctgctctttgctccgtgagaaagatccatctacgacctctggtcctcagaccaaccagcccaaggaacatctcaccaattttaaatccggtaagcggcctcttttcactctcttctccaacctctctctctatccctcaacctctttctcctttcaatcttcgtgccacgcttcaatctgtcccttctcttaatttcaattcctttcattttctggtagggacaaaggagacacgttttatctgtggaccgacccaaaactctggcgccggtcatggactagggaaggcagccttcccttggtgtttaatcattgcagggatgccgcctctctgattattcacccaggtttcagaggtgtcagaccacacaaggacgcctgccttagtccttcaacccttagcaacaagtcccgcttttctggaggaggggtaggaacactgacctcttatctctgcgccccgacctcttatctctgtgccccatcccttatttctatgccccgcctttttatctctgtgccccaaccccttatttccacaccccaaccccttctctgcttttctggaaggcaagaaccccccaccccttctccgtgtctctactcttttctctgggcttgcctccttcactatgggcaagcttccaccttccattcctccttcttctcccttagcctgtgtttttaagaacttaaaacctcttcaactctcacctgacctaaaatctaagtgtcttattttcttctgcaatgccgcttgaccccaatacaaactcgacagtagttccaaatagccagaaaacagcactttcaatttttccatcctacaagatctaaataattcttgtcgtaaaataggcaaatggtctgaggtgcctaacgcccaggcattcttttacacatcggtccctccccctagtctctgttcccaatgcaactcaccccaaatcttccttctttccctcccaccagtctcctcagtcccaaccccaagcgtcgctgagtctttctaatcttccttttctacagacccatctgacctctcccctcctcgccaggccgagctaggtcctaattcttcctcagcctccgctcctccaccctataaatcttttatcatctcccctcctcacacctggtccggcttacagtttcattccgtgactagccctcccccacctgcccagcaatttactcttaaaaaggtggctggagctaaaggcatagtcaaggttaatgctcctttctctttatctcaaatcagatagcgtttaggctctttttcatcaaatataaaaatccagcccagttcatggctcgtttggcagcaaccctgagacgctttacagccctagaccctaaaaggtcaaaaggccgtcttattctcaatatacattttattacccaatctgctcccgacattaaataaaactccaaaaactaaattccagccctcaaaccccacaacaggacttaattaacctcgccttcaaggtgtacaataatagaggcagccaagtagcaacatttctgaattgcaattccttgtctccactgcgagacaaaccccagccacatctccagcacacaagaacttccaaacatcaaaaccacagtggccaggggttcctccagaaccgcctcccccaggagcttgctacaagtgccagaaatctggccaccaggccaaggaatgcccgcagcccaggattcctcctaagccgtgtcccatctgtgaaggaccccactggaaatcggactgttcaactcacctggcagtcactcccagagcccctggaactctggcccaaggctctctgactgactccttcccagatcttctcagcttagcggctgaagactgatgctgtccgatctcctcggaagccccgtagaacatcacggacgccaggctttatgtaactctcacagtggagggtaagtccatccccttcttaatacggaggctacccactccacattaccttcttttcaagggcctgtttcccttgcctccataactggtaggtattgacagccaggcttcctaaacctcttgaaactccccaactctggtgccaacttagacaatactcttttaagcactcctttttagttatccccaccagcccagttcccttattaggccgagacactttaactaaattatctgcttccctgactattcctggactacagctacatctcattgccacccttcttcccaatccaaagcctcctttgggtcctcttcttgtatccccccaccttaacccacaagtataagatacctttactccctccttggtgaccgatcatgcaccacttaccatctcattaaaacctaatcacccttacccgctcaatgccaatatcccatcccacaccatgctttgaaaggattaaagcctgttatcactcgcctgctacagcatggccttttaaaacctataaactctccttacaattccattttacctgtcctaaaaccagatgatccttacaagttagttcgggatctatgccttatcaaccaaattgttttgcctatccaccccacggtgccaaacccatatactctcctatcctcaatagctccctccacaatccattattctgttctggatctcaaacatgctttctttactcttcctttgcacccttcatcccagcctctctttgctttcacctggactgaccctgacacccatcaagctcagcaaattacctgggctgtactgccgcaaagctgcacagacagatcccattacttcagtcaagcccaaatttcttcctcatctgttacctatctcagcataattctcataaaaacacatgtgctctccctgctggtagtgtccggctaatctcccaaaccccaatcccttctacaaaacaactcctttccttcctaggcatagttggatactttcacctttggatacctggttttgccatcctaacaaaaccgttatataaactcacaaaaggaaacctagctgaccccatagatcctaaatcctttctccactcctctttccattccttgaagacagctttagagactgcccccaccctagctcttgctgactcatcccaacccttttcattacacacagcagaagtgcagggctgtgcagttggaattcttacacaaggactgggatcgcatcctgtaggctttttgtccaaacaacttgaccttactgttttaggatggccatcatgtctccgtgcagcagctgctgccaccctaatacttttagaggtccttataatcacaaactattctcaactcactctctacagctctcataatttccaaaatctattttcttcctcacacctgatgcatatactttctgctccccggctccttcagttgtactcactctttgttgagtctcccacaattaccattgttcatggcccggacttcaatccagcctcccacattattcctgataccacacctgaccttcatgactgaatctctctgatccacctgatgttcaccccatttcccctcatttccttcttccctgtttctcaccctgatcgcacttggtttattgatggcagttccaccaggcctaatcaccacacaccagcaaaggcaggctatcctatattacaagccactagtccgcctcttagaacctctcatttcctttccatcgtggaaatctatcctcaaggaaataacatctcagtgttccatctgctattctactacttctcggattattcaggccccttcccttccctaaacatcaagctcagagatttgcccccacccaggactagcaaattagctttacttaacatgccccaagtcaggaaactaaaatacctcttggtctatgtagacactttcacttgataggaagatacctttcccacagggtctaagaaggccaccacggtcatttcttcccttctgtcagacacaattactcggtttggccttcccacctctacgcagtccgatagtagactggcctttattagtcaaatcagccaagcagtttttcaggctcttggtattcagtgaaacttttatatcccttacagtcctcagtcttcaggaaaagtagaacggactaatggtcttttaaaaacacacttcactaagctcagccaccaacttaaaaaggactggacaatacttttacctctttcttttctcagaattcaggcctgtcctcggaatgctacaaggtacagcccatttgagctcctgtgtggacgctcctttttatttagccccagtctcattccagacaccagaccaacttagattttgcccccaaaatcttgtcatccctactatcttctgtctagtcatactcctattcaccattctcaactacttatacatgctctgctcttgtttacactgctggtttacattgtttctccaagccatcacagctgatatctcctggtgctatccccaaactgccactcttaactcttgaagtaaataaataatctttgccggcaggactatgctgaatctccttaggcactctctaatcagatgtcctaggtcctcccaattcttagacctttaatacctgtttttctccctctcttattccatttagtttctcaattcatataaaactgtatccaggccatcaccaataattctaaatgacaaatgtttcttctaacagtcccataatgtcaccccttaccacaaagtcttccttcagcttaatccctcccactctaagttctcatgacgcccctaatcccgctcgaagcagccctgagaaacatcccccatcatctctccataccatcccccaaaattttcaccgtcccaacactttaccactatttcgttttatttttcttattaatataagaaaggaatgtcaggcctctgagcccaagctaagccatcatatcccctgtgacctgtgtacacatccagatggccagttcctgccttaactgatgacattccaccacaaaagaaatgaaaatagcctgttcctgccttaactgatggcattatcttgtgaaattccttctcctggctcatcctggctcaaaagctcccctactgagcaccttgtgacccccccactcctgcctgccagagaacaacccccctttttcctttacttacccaaatcccataaaacggccccacccctatctcctttcgctgactctcttctcagactcagcccacctgcacccaggtgaaataaacagctttattgctcacacaaagcctgtttggtggtctcttcacacagatgcaagtgaaa

SEQ ID NO: 165 - DNA, 4570 bp, Homo sapiens
caggcctctgagcccaagccaagccatcgcatcccctgtgacttgcacgtatatgcccagatggcctgaagtaactgaagaatcacaaaacaagtgaatatgccttgccccaccttaactgatgacattccaccacaaaagaagtgtaaatggccggtccttgccttaactgatgacattaccttgtgaaagtccttttcctggctcatcctggctcaaaaagcacccccactgagcaccttgtgaccccccactcctgcccactgagcaccttgcgacccccactcctacccgccagagaacaaaccccctttgactgtaattttcctttacctacccaaatcctataaaacggccccacccttatctcccttcgctgactctcttttcggactcagcctgcctgcacccaggtgaaataaacagccatgttgctcacacaaagcctgtttggtggtctcttcacacggacgtgcatgaaatttggtgccgtgactcagatcgggggacctcccttgggagatcaatcccctgtcctcctgctctttgctccgtgagaaagatccacctacgacctcaggtcctcagaccgaccagcccaagaaacaaacatctcaccaatttcaaatccggtaagcggcctctttttactctcttctccaacctccctcactatccctcaacctctttctcctttcaatcttggtgccacacttcaatctctcccttctcttaatttcaattcctttcattttctggtggagacaaaagagacatgttttatctgtgaacccaaaactccggcaccggtcacggacttggaaggcagccttcccttggtgtttaatcattgcagggacgcctctctgattatacactcacgtttcaagggtgtcagaccacgcagggacgccgccttggtccttcacccttagcggcaagtcccgctttcctggggcaggggcaagtacccctcagccccttctccttcacccttagtggcaagtcctgctttcctagggggcaagaagcccccaattgcttatttccgcaccccaacctcttatctctgtgccccaatcccttatttctgcaccctgacctcttatctctgtgccccaatcccttatttctgtgccccaaccccttctctgcttttctggagggcaagaaccccccaccccttctccgtgtctctactcttttctctgggcttgcctccttcactatgggtaagcttccaccttccattcctccttcttctcccttagcctgtgttctcaaaaacttaaaacctcttcaactcacacctgacctaaaacctaaatgccttattttcttctgcaatgctgcttgaccccaatacaaactcgacagtagttccaaatagccagaaaatggcactttgaatttttccatcctgcaaaatcgaaataattcttgtcgtaaaataggcaaacggtctgaggtgcctgacgtccaggcattcttttacacatcagtcccttcctaatctctgtgaccagtgcaactcgtcccaaatcttccttctttccctcccgcctgtcccctcagtaccaaccccaagcatcgctgagtctttctaatcttccttttctacagacccatctgacctctcccctcctccccaggctgctcctcgccaggctgagctaggtcccaattctttctcagcctctgctcctccaccctataatctttttatcacctcccctcctcacacctggtccggcttacagtttcgttccgtgactagccgactagccctccccctcctgcccagcaatttactcttaaaaaggtggctggagctaaaggaatagtcaaagttaatgctcctttttctttatcccaaatcggatagcgtttaggctttttttcatcaaatataaaaatccagcccagttcatggctcatttggcagcaaccctgagacactttacagccctagaccctaaaaggtcaaaaggccgtcttattctcaaaatacattttattacccaatctgctcccgacattaaataaaactccaaaaattaaatttcggccctcaaaccccacaacaggatttaattaacctcgccttcaaggtgtaccataatagaaaaaagttgcaattccttgcctccattgtgagacaaaccccagccacatctccagcacacaagaacttccaaaggcctgaaccgcagcagccaggcgttcctccagaacctcctcccacaggagcttgctacatgtgccggaaatctggccactgggccaaggaatgcccgcagcctgggattcctcctaagccgcgtcccatctgtgcgggaccccactgaaaatcggactgttcaactcacctggcagccactcccagagcccctggaactttggctcaaggctctctgactgactccttcccagatcttctcggcttagcagctgaagactgacactgcccgatcgcctcggaagccccctagaccatcacagacgccgagcttccggtaactctcacagtggaaggtaagcccgtccccttcttaatcaatacagaggctactcactccacattaccctcttttcaagggcccgtttcccttgcttccataactgttgtgggtattgacggccaggcttctaaacctcttaaaactccccaactctggtgccaacttagacaatactcttttaagcactcctttttagttatccccacctgcccagttcccttattaggccgagacactttaactaaattatctgcttccctgactattcctggactacagctatatctcattgccacccttcttcccaagccaaagcctcctttgcgtccacctcttctatccccccaccttaacccacaagtataagacacctctactccctccttggcgaccgatcatgcaccccttaccatctcattaaaacctaatcacccttaccccactcaaggccaatatcccatcccgcagcacactttaaaaagattaaagcctgttatcactcacctgctacagcatggccttttaaagcctataaactctccttacagttcccccattttacctgtcctaaaaccagacaagtcttacaagttagttcaggatctgcaccttatcaaccaaattgttgtgcctataaaccccgtggtgccaaacccatatactctcctatcctcaatacctgcctctacaacccattattctgttctagatctcaaacatgctttctttactattcctttgcacccttaatcccaggctctcttcgctttcccttggactgaccctgacatccatcaagctcagcaaattacctaggctgtactgccgcaaagcttcacagacagcccccattacttcaatcaagcccaaatttcttcctcatctgttacctatctcggcataattctcataaaaacacacgtgctctccctgccgatcgtgtccgactgatctctcaaacccaagcaccttctacaaaacaactcctttccttcctaggcatggttagcgcggtcagaatttttacacaagagccaggaccacaccctgtagcctttctctccaaacaacttgaccttactgttttagcctagccctcatgtctgcgtgcagtggctgccgctgctttaatacttttagaggccctcaaaataagtagaggcctttcctacagggtctgagaaggccaccgcagtcatctcttccgttctgtcagacataattcctcagtttagccttcccacctctatacagtctgataacagaccagcctttattagtcaaatcagccaagcagtttttcaggctcttggtattcagtgaaacctttatatcccttatggtcctccatcttcaagaaaagtagaatggactaaaggtcttttaaaaacacacctcaccaagctcagccaccaacttaaaaaggactggacaatacttttaccacattcccttctcagaattcaggcctgtcctcggaatgctacagggtacagcccatttaaggtccataacaccccccaaaaaattttcgccgccccaacacttcaacactattttgttttatttttcttattaatataagaaggcaggaatatcaggcctctgagcccaagccaagccatcgcatcccctgtgacttgcacgtatacgcccagatggcctgaagtaactgaagaatcacagaagaagtgaatatgccttgccccaccttaactgatgacattccaccacaaaagaagtgtaaatggccggtccttgccttaactgatgacattaccttgtgaaagtccttttcctggctcatcctggctcaaaaagcacccccactgagcaccttgcgacccccactcctacccgccagagaacaaaccccctttgactgtaattttcctttacctacccaaatcctataaaacggccccacccttatctcccttcgctgactctcttttcggactcagcccgcctgcacccaggtgaaataaacagccatgttgctcacacaaagtctgtttggtgctctcttcacacggatgcgcaagaaa

SEQ ID NO: 166 - DNA, 757 bp, Homo sapiens
tgtttacaggcagcatgcttgataaaagtcaccaccattctccattctcagtaaccaggggcacaatgcactgcggaaggccacagggacctctgccctggaaagccgggtattgcccaaggtttctccccatgtgatagcctgatatacggcctcgtgggatgggaaagacctgaccatccccacagcccgacacccatgaagggtctgtgctgaagaggattagtaaaagaggaaggcctcttgcagctgagataagaggaaaacctctgtctcctgcctgtccctgggaacagaatatctcggtataaaacccgattgtacatttgttctattctgagataggagaaaaactgccttgtggcaggaggtgagacatattggcagcaacgctgctctgttactctttactccactgagatatttgggtggagaaaagcataaatctggcctatgtgcacgtccaggcatagtaccttcccttgaacttatttgtgacacagaatcctttgctcacatgttttcttgctgaccttctccccactatcaccctgctctcctgccgcattccccttgtggagatagtgaaaacagtaatcaataaatactgagggaactcagagactggtgccggtgcaggtcctctgtatgctgagtgccggtctcctgggcccacttgtctttctctatactttgtctcgtcttttttctgtctctcgtcccacctgacaagaaatactcacaggtgtagaggggc

SEQ ID NO: 167 - DNA, 307 bp, Homo sapiens
tgggtcaggcacaaagtaagcccaccccactaggaactatgttgaaaattttcaagaaaggatttaagggagattacagtgttactctgacaccaggaaaacttagaactttgtgtgaaatagactggccagcattagaggtgggttggccatcagaaggaagcctggacaggtcccttgtttcaaaggtatggcacaaggtaacctgtaagccagggcacccagaccagttcccatacatagatacttggttacagcttgttttagacccccctcaacctcccatagtggttgagagaacagcagc

SEQ ID NO: 168 - DNA, 4776 bp, Homo sapiens
gtcaggcctctgagcccaggccaggccatcgcaccccctgtgacttgcacgtatacatccagacggcctgaagtaactgaagatccacaaaagaagtaaaaacagccttaactgatgacattccaccattgtgatttgttcctgccccaccctaactgatcaatgtactttgtaatatcccccacccttaaggtactttgtagtctcccccacccttaagaaggttctttgtaattctccccacccttgagaatgtactttgtgagatccacccctgcccaccagagaacaaccccctttgactgtaattttccattaccttcccaaatcctataaaatggccccacccctatctcccttcgctgactgtcttttcggactcagcctgcctgcacccaggtgaaataaacagccatgttgctcacacaaagcctgtttggtggtctcttcacagggacacgcatgaaatttggtgccgtgactcggatcgggggacctcccttgggagatcaatcccccgtcctcctgctctttgctccatgagaaagatccacctacgacctcaggtcctcagaccgaccagcccaagaaacatctcaccaatttcaaatccggtaagcggcctctactcttctccaacctccctcactatccctcaacctctttctcctttcaatcttggagccacacttcaatctctcccttctcttaatttcaattcctttcattttctggtagagacaaaagagacatgttttatccgtgaacccaaaactctggcgccggtcacggactgggaaggcagccttcccttggtgtttaatcattgcagggatgcctctctgattatacactcacgtttcaagggtgtcagaccacgcagggacgcctgccttggtccttcacccttagcggcaagtcccactttcctggggcaggggcaagtacccctcaaccccttccccttcaccctcagcggcaagtcctgctttcctggggcaggggcaagtacccctcaaccccttccccttcaccctcagcggcaagtcctgctttcctggggcaggggcaagtaccccttccccttcaccctcagcggcaagtcctgctttcctggggcaggggcaagtacccctcaaccccttctccttcatccttagcagcaagtcccgctttcctagggggcaagaaccccccaatcacttatttccacaccccaacctcttatctctgtgccccaatcccttatttccgcaccctgacctcttatttccatgccccaaccccttctctgcttttctggagggcaagaaccccccaccccttctctgtgttgctactcttttctctgggcttgcctccttcactatgggtaagcttccaccttccattcctccttcttctcccttagcctgtgttctcaaaaacttaaaacctcttcaactcacacctgacctaaaacctaaatgccttactttcttctgcaatgccgcttgactccaatacaagctcgacagtagttccaaatagccggaaaacggcactttcaatttttccatcctacaagatctaaataattcttgtcgtaaaatgggcaaatggtctgaggtacctgaagtccaggcattcctttacacatcagtcccttcctagtctctgtgcccagtgcaactcgtcccaaatctttcttctttccctcccgcctgtcccctcagtcccaaccccaagtgtcgctgagtctttctgatcttccttttctacagacccatctgacctctcccctcctcgccagcccaagctaggtcccaattcttcctcagcctctgctcctgcaccctgtaatctttttatcgcctcccctcctcacacctggtcgggcttacagtttcgttccgtgactagccctcccccacctgcccagcaatttactcttaaaaaggtggctggagccaaaggcatagtcaaggttaatgctcctttttctttatcccaaatcagatagcgtttaggctctttttcatcaaatataaccctgagatgcttcacagccctagaccctaaaaggtcaaaaggcaatattattctcaatatacattttattacccaatctgctcccgacattaaatctccaaaaattaaattccggccctcaaaccccacaacagaatttaattaacttcaccttcaaggtgtacaataatagaaaaagttgcaattccttgcctccactgtgagacaaaccccagccacatctccagcacacaagaacttccaaacgcctgaaccacagcggccaggcgttcctccagaacctccttccccaggagcttgctacaagtgccagaaatctgaccaccaggccaaggaatgcatgcagcccaggattcctcctaagccgtgtcccatctgtgcgggaccccactggaaattggactgttcaactcacctggcagccactcccagagtccctggaactctggcccaaggctctctgactgactccttctcggcttagcggctgaagactgatgctgcccgatcgcctcggaagccccgtagaccatcacggacgccgagcttccggtaactctcacagtggaaggtaagcccgtccccttcttaatcaatacggaggctacccgctccacattaccttcttttcaagggcctgtttcccttgcctccataactgtgggtattgacagccaggcttctaaacctcttaaaactcccccactctggtgccaacttggacaacactcctttatgcactcttttttagttattcccacctgcccagttcccttattaggccgagatattttaaccaaattatctgcttccctgactattcctggactacagccgcatctcattgccgaccttctccccaactcaaagcctccttcgcgtcttcctcttatatccccccaccttaacccacaagtatgggacatctctactccttccatcacccttaccccgctcaacgccaatatcccatcccacagcatgctttaaaaggattaaagcctgttatcactcgcctgctacagcatgggcttctaaaacctataaactcttacaattcccccattttacctgtccaaaaaccggataagtcttacagattagttcaggatctgcgtcttatcaaccaaattgttttgcctatccaccctgtggtgcccaacccgtacactcttttgtcctcaatacgttcctccacaactcactattctgttctccatcttaaagatgcttttttcactattcccctgcacccctcgtcccagcctctctttgctttcacttagactgaccctgacaccccattaggctcagcaaattacctgggctgtactgctgcaaagcttcacagacagcccccattacttcagtcaagcccagatttcttcctcatctgttacctatctcggcgtaattctcgtaaaagcacacgtgctttccctgccaatcgtgtccgactgatctctcaaaccccagcaccttctacaaaacaacaactcttttccttcctaggcatggttagcgtggtcggaattcttacacaagagccaggaccacaccctgtagcctttctgtccaaacaacttgaccttactgttttagcctagccctcatgtctgcgtgcagcagctgctgctgctttaatacttttagaggccctcaaaatcacaaactttatcagtcctccaggcccaagttgactctttagctgcagttgtcctccaaaaccgccgaggccttgacttacttactgctgaaaaaggaggactctgcatattcttaaatgaggagtgttgtttttacctaaatcagtctggcctggtgtatgacaacataaaaaaactcaaggatagagcccaaaaacttgccaaccaagcaagtaattacgctgaacccccttgggcactctctaattggatgtcctgggtcctcccaattcttagtcctttaatacccatttttctcctccttttattcagaccttgtatcttccatttagcttctcagttcatccaaaactgtatccaggccatcaccaatcattctatatgacaaatgtttcttctaacatccccacaatatcatcccttaccacaagacttcccttcagcttaatctctcccactttatgttcccacgccgccccaatcccacttgaagcagccctgagaaacatcgcccattctctctccataccaccccccaaaaattttcgccgctccaacacttcaacactattttgttttatttgtcttattaatataagaaggcaggaatgtcaggcctctgagcccaggccaggccatcgcatcccctgtgacttgcacgtatacatccagatggcctgaagtaactgaagatccataaaagaagtaaaaacagccttaactgatgacattccaccattgtgatttgttcctgccccaccctaactgatcaatgtactttgtaatatcccccacccttaaggtactttgtagtctcccccacccttaagaaggttctttgtaattctccccacccttgagaatgtactttgtgagatccacccctgcccaccagagaacaaccccctttgactgtaattttccattaccttcccaaatcctataaaatggccccacccctatctcccttcgctgactgtcttttcggactcagcctgcctgcacccaggtgaaataaacagccatgttgctcacacaaagcctgtttggtggtctcttcacacggacgcacatgaaa

SEQ ID NO: 169 - DNA, 755 bp, Homo sapiens
gagagacaggactaagctggatttcctaggccgactaagaattcctaaacctagctgtggacggtgaccacacccacctttaaacacggggcttgtaactcagctcacacctgaccaatcaggtagtaaagagggctcactaaaatgcaaattaggctaaaaacaggaggcaaagaagtagtcaaatcatctatcatctgagagcacagggtgagggacaatgattgggatataaaccccaggcattccggagctgggatcgggcaaccccctttgggtcccctcccattgtatgggagctctgttttcactctattaaatcttgcaactgcacactcttttggtccatgtttgttctggctggagctgagcttttgctcaccgttcatcactgctgaatgctaccatcgcagacccaccgttgacttccagccctctggatcctgcagggtgtccgctgcactcctgatctagtgaggcgcccattgcccctcctgatggggctaaaggctcgccattgttcctgcgtggctaaatgcccaggtttgtcctattctagccaaacactagtcgctgggttcaacggttctattccgtgactcacggcttctaatagagctataacaccgcatggcccaaggttccattccttggaatctgtgaggccaagaaccccaggccggagaacaaaaggcttcctaccatgttgggagcagccgtcaccatcttgggagctctaagaacaaagacccacc

SEQ ID NO: 170 - DNA, 8738 bp, Homo sapiens
gtcaggcctctgagcccaagccaagccatcgcatcccctgtgacttgcatgtatatgcccagatggcctgaagtaactgaagaatcacagaagaagtgaaaatgccctgccccaccttaactgatgacattccaccacaaaagaagtgaaaatggctggtccttgccttaagtgatgacattaccttgtgaaagtccttttcctggctcatcctggctcaaaaagctcccccactgagcaccttgcgacccccactcctgcctgccagagaacaaaccccctttgactataattttcctttacctacccaaatcttataaaatggccccacccctatctcccttcactgactctctttttagactcagcccgcctgcacccaggtgattaaaagcttttattgctcacacaaagcctgtttggtggtctcttcacagggacgtgagtgaaatttggttctgtgactcagatcggggaacctcccttgggagatcaatcccctgtcctcctgctctttgctccatgagaaagctccacctacgacctcaggtcctcagaccaaccagcccaagaaacatctcaccaatttcaaatccagtaagcggcctctttttactctcttctccaacctccctcactatccctcaacctctttctcctttcagtcttggcaccacacttcaatctctcccttcttttaatttcaattcctttcattttctgatagagacaaaggagacacattttatccgtggacccaaaactctggcgcctgtcacagactgggaaggcagccttcccttggtgtttaatcattgcagggacgcctctctgattatttagccatgtttcagaggtgtcagaccacacagggatgcctgccttggtccttcacccttagtggcaagtcctgcttttctgggggaggggcaagtaccccaaccccttctcgccatgtctctaccccttctctgcctttctggggggcaagaaacccccaaccccttctccttcacccttagcagcaagtcctgcttttctaggggaggggcaagtaccccaacctcgtatctctgtgccccaatcccttatttctgcaccccgacctcttatctctgtgccccaatcccttatttctgcaccccgacctcttatctctgtgccccaatcccttatttctgcaccccgacctcttatctctgtgccccaatcacttatttctgcaccccgacctcttatctctgtgccccaatcccttatttctgcaccccgacctcttatctctgtgccccaatcccttatttccacaccccaacttcttatctctgtgccccaatcccttatttccatgctccgacctcttatctctgcaccccaaccccttatttccgcaccccgacccctttcccgcttttctggagggtaagaacctccgaaccccttccctccgtgtctctactctctcttttctctgggcttgcttctttcactataggcaaccttccaccctccattcctcctccttctcccttagcctgtgtcctcaaaaacttaaaacctcttcaactcacacctgacctaaaacctaaatgccttattttcttctgcaacactgcttagccccaatacaaacttggcaatggctctaaaatggccagaaaacggcacttttgatttctccatcctacaagacctaaataatttttgtcaaaaaataggaaaacggtctgaggtgcctgacgtccgggcattcttttacacatcggtccctttctagtctctgttcccaatgcaactcgtcctaaatcttccttctttccctcccacctgtcccctcagtcccaaccccaagcgtcgctgagtctttctaatcttccttttctacagacccatctgacctctcccctcctcaccaggccaagctaggtcccaattcttcctcagcctctgctcctccactctatagtccttttatcacctcccctcctcacacctggtctggcttacagtttccttccatgactagctctcccccacctgcccagcaatttcctcttaaaaaggtggctggaactaaaggcatagtcaaggttaatgctcctttttctttatcagacctctcccaaatcaggcagcatttagactctttttcatcaaatataaaaaccccagcccagttcatggatcatctggcagcaaccctgagacgctttacagccctagaccctaaaaggtcaaaaggccaacttattctcaatatacattttattacccaatctgctcccgacattaaactccaaaaattaaattccagccctcaaaccccacaacaggatttaattaacctcaccttcaaggtgtacgataatagaaaaaagttgcaattccttgcctccactgtgagacaaaccccagccacatctccagcacacaagaacttccaaacgcctgaaccacagaagccaggcgttcctccagaacctcttcccgcaggagcttgctacaagtgccagaaatctgaccaccaggccaaggaatgcctgcagcccaggattcctcctaagccgtgtcccatctgtgcacgaccccactggaaatcgaactgttcaactcacttggcaaccactcccagagcccctggaactctggcccaaggctctctgactgactccttcccagatcttctcagcttagcagctgaagactgacactgcccggttgccttagaagccagttcacagacactctaggtaactctcacagtggaaggtaagtctgtccccttcttagtcaatacggaggctacccattccaccttaccttcttttcaagggcctgtttcccttgcctccgaactgttgtgcgtattgacagccaggcttctaaacctcttaaaactccccaactctggtgccaacttagacaacactcttttaagcactcctttttagttatccccacctgcccagttcccttattagcccgagacactttaactaaattatctgcttccctgactattcctggactacagctgcatctcattgccgccctttttccctatccaaagcctcctttgcgtcctcctcttgtatccccccaccttaatccacaagtataagatacctctaccctctacttggcgaccagtcatgcaccccttaccatctcattcaaacctaatcacccttatcccgctcaatgccaagatcccatcccacagcatgctttaaaaggattaaagcctattatcactcacctgctatggcatggccttttaaagcctataaattctcctttcaattcccccattttacctgtcctagaaccagacaagccttagaggttagttcaggatctgtgccttatcaaccaaattgttttgcctatccaccccgtggtgccaaacccatatactctcctatcctcaatacctgcctctacaacccattattctcaaacatgctttctttactattcctttgcacccttcatcccagcctctcttggctttcacttggactgaccctgacacccatcaggttcagcaaattacctaggctttactgctgcaaggcttcacagacatcccccattacttcagtcaagcccaaatgtcttcctcatctgttacctgtcttggcataattcttataaaaacaaacatgctctccctgcaaatcgcgtctgactgatctctcaaaccccaacaccttctacatcctaggcatagttagatacttttgcctttggatacctggttcagccatcctaataaaaccattatataaacccacaaaaagaaacctagctgaccccatagatcctaaatcctttccccactcctctttccattccttgaagacagctttagagactgcccccactctagctctccctgactcatcccaacccttttcattacacacagctgaagtgcagggctgtgcagtcagaattcttacacgaggaccaggatcacatcctgtagcctttttgtccaaataacttgaccttactgttttaggctggccatcatgtctccgtgcagcagctgctgccaccctaatacttttagaggccctcaaaatcacaaactatgctcaactcactctctacagctctcataatttccagaatcaattttcttcctcacacctgacacatatactttctgccccccggctccttcagctatactcactctttgttgagtctcccacaattaccattgttcctggcccggacttcaatctggcctcccacattattcctgataccacacctgaccctcatgagtgcatctctctgatccacctgacgttcacccaatttccccacatttccttcttccctatttctcaccctgatcacacttggtttattgatggcagttccaccaggcctaatcgtcactcaccagcaaaggcaggctatgctatagtatcttccacatctatcattgaggctaccactctgcccccctccactacctctcagcaagccgaactagttgccttaattcaagccctcactcttgcaaaaggactacatgtcgatatctatattgattctaaatatgctttcatattctgcaccaccatgcggtcatatgggctgaaagaggtttcctcactacacaagggtcctccatcattaatgcctctttaataaaaactctgcttaaggccgctttacttccaaaggaagctagggtcattcactgcaaggggcatcaaaaggcgtcagatcccattgctctaggcaacgcttatgctgataaggtggctagacaagcagctagttttccaactcctgtctctcacagcaatgcttatgctgataaggtggctagacaagcagctagctctccaacttctgtccctcacggccagtttttctccttcacatcggtcactgccacctactcccccactgaaacttccacctatcagatctctttccgcacaaggcaaatggttcttagaccaaggaaaatatctccttccagcctcacaggcccattctattctgtcgtcatttcataacctcttccatgtaggttacaagctgctagcctgtctcttagaacctctcatttcctttctatcacagaaatctatcctcaaggagatcacttctcagtgttccatctgctattctactacccctcagggattgttccggcctactcccttccctgcacatcaagctcggggatttgcccctgcccaggactggcaaattgactttactcacatgccccgagtcagaaaactaaaatacctcttagtctaggtagacactttcactggataggtagagaggcctttcccacaaggtctgagaagaccaccgcggtcatttcttcccttctgtcagacataattcctcggtttggccttcccacctttatacagtctgataatggaccagcctttactagtcaaatcacccaagcagtttctcaggctcttaatattcagtggaaccttcatatcccttaccatcctcaatcttcacaaaatgtagaacagactaatggtcttttaaaggtacacctcaccaagctcagcctccaacttaaaaaggattggacagtacttttacttcttgcccttctcagaattagagcctgtccttgagatgctacagggtacagtccatttgaacttttatatggatgcactttcttgcttggccccaacctcatcccagacaccagccttctaggtgactatcttccagtcctccaacaggctagacaggaaatttgccaggctgctaatcttctcctgcctactccagatccccagccatatgaagacaccctagctggacgatcagttcttcttaagaatctgacccctcaaactctacaacctcgatagaccggaccctacttagtcatctatagtaccccgactgccgtccgcctgcaggatcttccccacgaggttcactgttccagaataaagctgtgtccatcggacagccagcctaatccctcctcttcctcctggaagtcgcaagtactctcccctacttcccttaactcactcgtatttctgaagaacagtaatagagcctaatacatcccttcattctattaggtctgttcgtccttaccctactttttgcaacagggctttacgaagtcacccccaccacttaggccgagccccaaaaaacttgtcatccctactattttctgtctagtcatattcctattctccgttctcaactacttataaatgccctactcttgtttacactgccggtttacactgtttcttcaagccatcacagctgatatctcttggtgctatccccaaaccgccactcttaattccctcttagagtgaatagatgatctttgctggcagggcacacccttcaatacttccaccctgatgaagttctattctttacttttatactcactcttattctcattcccattcttacgccaccctttacctctccccagctatctccaccacactgtcaaccttacccattctctcccagccacttctaatccctccttagcgaacaactcctggctttgtgtttccctttcttccagtgcctacatagctgtccccgccttacagacagactggacaacatctcctgtctccttacacctctgaacttcctttaacagccctcacctttaccctcctgaagaactcatttactttctagacaggtccagcaagacttccccagacatttcccatcagcaagctgccgccctcctccgcacttatttaaaaaacctttctccttatattaactctactccccccatatttggacctctcacaacacaaactactattcctgtggccgctcctttatgtatctcttggcaaagccccactggaattcccctgggtaacctttcaccttctcgatgttcctttactcttcaactccgaagcccaactacacacatcactgaaacaattggagccttccagctctatattacagacaagccctctatcaatactgacaaactcaaaaacgttagcagtaattgttgcttaggaagacacttaccctgtatttcactccatccttggctaccttccccttgctcattagactctcctcccaggctctcttcttgtttacttgtacccagccccaaaaataacagtgaaaggttgctcacagatactcaatattttttcatacaccattaaaattgaacctcctcctctacgcagtgaccccatctgtccccattacaacctctgacagctgccaccctagctggatccctaggattctgggtacaagacacccctttcagcactccttctcacctttttactttacatctccagttttgcctcgcacaaggtctattcttcctctgtggatcctctacctacatgtatctacctgctaattggacaggcacatgtacactagttttccttacccccaaaattcaatttgcaaatgggaccgaagagctccctgttccccttatgacaccgacacgaccaaaaagagttattccactaattcccttgatggtcggtttaggactttctgcctccactattgctctcggtactggaatagcaggcatttcaacctctgtcacgaccttccgtagcctgtctaatgacttctctgctagcatcacagacatatcacaaactttatcagtcctccaggcccaaattgactctttagctgcagttgtcctccaaaaccgccgaggccttgacttactcactgctgaaaaaggaggactctgtatattcttaaatgaagaatgttgtttttacctaaatcaatctggcctggtgtatgacaacataaaaaaactcaaggatagagcccaaaaacttgccaaccaagcaattatgctgaatccccttgggcactctctaattggatgtcctgggccctcccaattcttagtcctttaatacccatttttcttcttcttttattcagaccttgtatcttccgtttagtttctcagttcatccaaaaccatatccaggccatcaccaatcattctataccacaaatgtttcttctaacatccccacaatatcaccccttaccacaagatctcccttcagcttaatctctcccactctaggttcccacgccacccctaatcctgcttgaagcagccctgagaaacatcacccattctctctctccataccaccccccaagaattttcaccgcccccacacttcaacactattttgttttatttttcttattaatataagaaggcaggaatgtcagacctctgagcccaagccaagccatcgcatcccctgtgacttgcacatatatgcccagatggcctgaagtaactgaagaatcacaaaagaagtgaaaatgccctgccccaccttaactgatgacattccaccacaaaaaaagtgtaaatggccggtccttgcctgaagtgatgacattaccttgtgaaagcccttttcctggctcatcctggctcaaaaagctcccccactgagcaccttgcgacccccactcctgcccgccagagaacaaaccccctttgattggaattttcctttacctacccaaatcttataaaacggcctcacccctatctcccttccctgactctcttttcagactcagcccgcctgcacccaggtgattaaaagcttttatggctcacacaaagcctgtttggtggtctcttcacatggacgcgcatgaaa

SEQ ID NO: 171 - DNA, 699 bp, Homo sapiens
ttacagtaggtagtcaggcagacaggagcagggcaggagaggattccgctaaccaggaatgttaggtgaccatcatgtgacggtgaggcagctgttacattgactctctaaaataataattggtcacaactggcaccagagaaaggcagtatcccaatagataggaaaaacctataattggtgataagcagcttcccattaagatcacaggagttgggtgagtgggctcaagcatatgcagtaagaggcaaaatggtggagtttggctggtatatgaccttctaggaacattcaacctggaagggaagaattcctcaagtgagcatgtgtacacctccagtaaacacactgtgcatgcgacccctcccaagtgctgacaggctagtgggcatgtagagagcccaccccaagagaagaatcaggggagaaggaacacaagaccccagaagcatgccaatgtataaaactccaagtcagaggtcaaactgggcatttggatctctcaagtcacctgcttggaccctttccaaatgtactttactttctttcattctgctctaaagtttttagcaatttttcctcctgctctaaaacttgccttggtcacacactctgccttgtgccctgtggtcagattctttcttctgaggaggcaagaactgaggttgctgcacacctgtacagatttgccactgctaa

SEQ ID NO: 172 - DNA, 334 bp, Homo sapiens
tctcccaagtgctagcaggcctctgcacatgcagacagcccaccccaagggaagaatcaggggagaagggatgcaagatgccggaagtatgccaacatgtaaaacctcacatcaaaggtcaaacagtgcacttgatgtctcaagtcacccacttgttctcttccaagtgtactttacttcctttcattccttctctaaagctttttaataaactttcactcctgctctaaaatttgccttggtctctccttctgccttatgcccctcagtcaaattctttcttctgacgaggcaagaattcaggttgctgtagacctgtacaaattcactgcca

SEQ ID NO: 173 - DNA, 4053 bp, Homo sapiens
gtcaggcctctgagcccaagccaagccatcgcatcccctgtgacatgcgcgtatacatccagatggcctggagtaactgaagatccacaaaagaagtgaaaatagccttaactgatgacattccactattgtgatttgttcctgccccaccataactgatcaatgtactttgtaatctcccccacccttaagaaggttctttgtaattctccccacccttgagaatgtactttgtgagatccacccctgcccacaaaacattgctcttaacttcaccgcctatcccaaaacctgtaagaactaatgataatccatctcccttcgctgactctcttttcggactcagcccgcctgcacccaggtgaaataaacagccatgttgctcacacaaagcctgtttggtggtctcttcacacggacgtgcatgaaatttggtaccatgactcggttcggaggacctcccttgggagatcaatcccctgtcctccttgctctttgctgcatgagaaagatccatctatgtatgacctcaggtcctcagatggaccagcccaagaaacatctcaccaatttcaaatccagtaagtagcctctttttactctcttctccaaattccctcactatccctcaacctctttctcctttcaatcttggtgccacacttcaatctctcccttctcttaatttcaattcctttcattttctggtagagacaaaggagacacgttttatccgtggacccaaaactccggcaccggtcacggactgggaaggcagccttcccttggtgtttaatcattgcagggacatctctctgattattcacccacgtttcaaaggtgtcagaccacgcagggacgcctgccttggtccttcacccttagcggcaagtcccgcttttctgggggaggggcaagtaccccaaccccttctctctgtgtctctaccccttctctggttttctgggggaggggcacataccccaaccccttctcttcatgtctctaccccttctctggttttctgggggaggggcaagtaccccaaacccttctctccgtgtctctaccccttctctgctcttctggggcaggggcaagaacccctcaaccccttctccttcacccttagtggcaagtcccgcttttctagagggcaagaacccccaatcccttatttccgtgccccaacaccttctctgcttttctggagggcaagaaccccctaccccttctccgtgtctctactcttttctctgggcttgcctccttcactatgggcaagcttccaccttccattcctcctccttctcccttagcctgtgttcttaagaacttaaaacctcttcaactctcacctgacctaaaatctaagcatcttattttcttctgcaatgccgcttgaccccaatacaaactcgacagtagttccaaatagccagaaaacggcactttcaatttttccatcctacaagatctaaataattcttgtcataaaatgggcaaatggtctgagatgcctgacatccaggcattcttttacacatcagtcccttcctagtctctgtgcccaatgcaactcatcccaaatcttccttctttccctcttgcctgtcccctcagtcccaacgtcaagcgtcactgcgtctttctaatcttccttttctacagacccatctgacctctcccctcctccccaggctgctcctcgccaggccaagctaggtcccaattcttcttcagcttctgctcctccactctataatccatttatcacctcccctcctcacacctggtccggcttatggtttcattctgtgactagccctcccccacctgcccagcaatttactcttaaaaaggtggctggagctaaaggcatagtcaaggttaatgctcctttttctttatcccaaatcaggtagcctttaggctctttttcatcaaatataaaaacccagcccagttcatggctcgtttggcagcaaccctgagaagctttacagccctagaccctaaaaggtcaaagggccgtcttattcttaatatacattttattacccaatctgctcctgacattaaataaaactccaaaaattaaattccggccctcaaaccccacaacaggatttaaccttgccttcaaggtgtacaataatagaaaaaagttggaattccttgcctccactgtgagacaaaccccagcaacatctccagcacacaagaacttccaaacacctaaacagcagtggccaggtgttcctccagaactgcctcccccaggagcttgctacaagtgccagaaatctggccaccgagccaaggaatgcccgcagcccgggattcctcctaagccgtgtcccatctgtgtgggaccccactgaaaatcggactgttcaactcacctggcagcccctcccagagcccctggaactctggcccaaggctctctgactgactccttcccagatcttctcggcttaatggctgaagactgacgctgcccgatcgccttggaagccccgtagaccatcatggacaccgagctttaggtaactctcacagtggaaggtaagtccgtcctcttcttaatcaatacggaggctacccactccacattaccttcttttcaagggcctgtttcccttgcctccataactgttgtgggtattgacggccaggcttctaaacctcttaaaactccccaactctggtgtcaacttagacaatactcttttaagcactcctcttaattatccccacctgccccgttcccttattaggccgagacactttaactaaattatctgcttccctgactattcctggattacagttacatctcattgctgcccttctttccaatccaaagcctcctttgtgtcctcctcttgtatcccccgaccttaacccacaagatacctctactccctccttggcgacctatcatgcaccccttaccatctcattaaaacctaatcatccttaccccgctcaatgccaatatcccatcccacagcatgctttgaaaggattaaagcctgttatcacttgcctgctacagcatggccttttaaagcctataaactctccttacaattcccccattttacctgtcctaaaaccagacaagccttacaagttagttcaggatctatgccttatcaaccaaattgttttgcctatccaccccatggtgccaaacccatatactctcctatcctcaatacctccctctactacccattattctgttctggatctcaaacatgctttctttactattcctttgcacccgtcatcccagcctctctttgcttttacttggactgaccctgacacccatcagactcagcaaattacctgggctgtactgccacaaagcttcacagacagcccccattacttcagtcaagcccaaatttcttccttatctgttacctatctcagcataattctcataaaaacacacattctctccctgctgatcatgtccgattaatctcccaaacctcaatcccttctaaaaaacaagaactcttttccttcctgggcatggttagtgcggccagaattcttacacaagagccaggaccacaccgtgtagcctttctgtccaaacaacttgaccttactgttttagcctagccctcatgtctgcgtgcagcggctgccgctgcttgaatacttttagaggccctaaaaatcacaaactatgctcaactcactctctacatttctcataacttccaaaatctattttcttcctcatacctgacgcatatactccctggctccttcagctgtacttactctttgttaagtcccacaattaccattgttcctggcccggacttcaatctggcctcccacattattcctgataccacacctgacctccatgactgtatgtctctgatccaactgacattcaccccatttccccatatttccttctttccttttcctcaccctgatcacgcttgatttattgatggcagttccaccaggcctaatcaccacacaccagcaaaggcaggctatgcgatagca

SEQ ID NO: 174 - DNA, 5800 bp, Homo sapiens
gtcaggcctctgagcccaagccaagccatcgcatcccctgtgacctgcacgtatacacccagatggcctgaagtaactaaagaatcacaaaagaagtgaatatgccctgccccaccttaactgatgacactccaccacaaaagaagtgtaaatggccggtccttgccttaactgatgacattaccttgtgaaagtcctcttcctggctcatcctggctcaaaaagcacccccactgagcaccctgtgacccccactcctgcccactgagcaccttacgacccccactcctactcgccagagaacaaaccccctttgactgtaattttcctttacctacccaaatcctataaaacggccccacccctatctcccttcgctgactctcttttcggcctcagcccgcctgcacccaggtgaaataaacagccatgttgctcacacaaagcctgtttggtggtctcttcacacggacgcacatgaaatttggtgccgtgacttggatcgggggacctcccttaggagatcaatcccctgtcctcctgctctttgctccgtgagaaacatccacctacgacctcaggtcctcagaccgaccagctcaagaaacatctcaccaatttcaaatctggtaagcggcctctttttactctcttctccaacctccctcactatcccttaacctctttctcctttcaatcttggcgccacacttcaatctctcccttctcttaatttcaattcctttcattttctggtagagacaaaagagacatgttttatccatgaacccaaaactccggcgccagtcacggactgggaaggcagccttcccttggtgtttaatcattgcagggacgcctctctgattatacactcacgtttcaagggtgtcagaccacacagggacgcctgccttggtccttcacccttagtggcaagtctcgctttcctggggcaggggaaagtacccctcaaccacttccccttcactcttagcggcaagtcccgctttcctggggcaggggcaagtacccctcaaccccttctccttcacccttggcggcaagtcccgctttcctagggggcaagaagcccgcattcgcttatttccgcaccccaacctcttatctctgtgccccaatcccttatttccacaccctgacctcttatctctgtgccccaatcccttatttccgtgccccaaccccttctccgcttttctggaggacaagaaccccccaacacttctccgtgtctctactcttttctctgggcttgcctccttcactatgggtaagcttccaccttccattcctccttcttctcccttagcctgtgttctcaaaaacttaaaacctcttcaactcacacctgacctaaaacctaaatgccttattttcttctgcaatgccgcttgaccccaatacaaactcgacagtagttccaaatagccagaaaatggcactttgaatttttccatcctgcaaaatctaaataattcttgttgtaaaataggcaaacggtctgaggtgcctgacgtccaggcattcttttccacattagtcccttcctagtctctgtgaccagtgcaactcgtcccaaatcttccttctttccctcccacctgtcccctcagtaccaaccccaagcgtcgctgagtctttctaatcttccttttctacagacccatctgacctctcccttcctccccaggttgttcctcgccaggccgagctaggtcccaattcttcctcagcctctgctcctccaccctataatctttttatcacctcccctcctcacacctggtccggcttacagtttcattccgtgactagccctcccccacctgcccagcaatttactcttgaaaaggtggctggagctaaaggcatagtcaaggttaatgctcctttttctttgtcccaaatcagatagcgtttaggctctttttcatcaaatataaaaatccagcccagttcatgacttgtttggcagcaactctgagacactttacagccctagacactaaaaggtcaaaaggccgtcttattctcaaaatacattacccaatctgctcccgacattaaataaaactccaaaaattaaattccggccctcaaaccccacaacaggatttaattaacctcgccttcaaggtgtacaataatagaaaaaagttgcaattccttgcctccactgtgagacaaaccccagccacatctccagcacacaagaacttccaaacgcctgaaccacagcggccaggcgttcctccagaacctcctccaacaggagcttgctacacgtgccggaaatctggccactgggccaaggaatgcccacagcccgggattcctcctaagccacgtcccatctgtgtgggaccccactgaaaatcgactgttcaactcacctggcagccactcccagatcccctggaactctggcccaaggctgtctgactgactccttcccagatcttctcggcttagcagctgaagactgacactgcccgatcgcctcagaagccccctagaccatcacggacgccgagcttccagtaactctcacagtggaaggtaaggccgtccccttcttaatcaatatggaggctacccactccacattaccttcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggctgagacactttaactaaattatctgcttccctgactatcctggactacagctatatctcattgccgcccttcttcccaatccaaagcctcctttgcgtcctcctcttgtatccccctaccttaacccacaagtataagatacctctactccctccttggcgaccgatcacgcaccccttaccatctcattaaaacctaatcacccttaccccactcaatgccaaaatcccatcccgcagcacactttaaaaagattaaagcctgttatcactcgcctgctacagcatggccttttaaagcctataaactctccttacaattcccccattttacctgtcctaaaaccagacaaaccttacaagttagttcaggatctgcactttatcaaccaaattgttttgcctatccaccccgtggtgccaaacccatatactctcctatcctcaatacctgcctctacaacccattattctgttctagatctcaaacatgctttatttactattcctttgcacccttaatcccagcctctcttcgctttcacttggactgaccctgacacccatcaagctcagcaaattacctaggctgtactgccgcaaagcttcacagacagcccccattacttcaatcaagcccaaatttcttcctcaactgttacctatctcggcataattctcataaaaacacacgtgctctccctgccaatcgtgtctgactgatctctcaaaccccaaactctacaaaacaactcctttccttcctaggcatggttagggtggtcagaattcttacacaagagccaggaccacaccctgtagccttctgtccaaacaacttgaccttactgttttagcctagcccgtatgtctgcgtgcggcagctgccactgcattaatacttttagaggccctcaaaatcacaaactatgctcaactcactctctacagttctcataacttccaaaatctattttcttcctcatacctgacgcatatactttctgcttcccagctccttcagctatactcactctgttgagtctcccacaattatcattgttcctggcccatacttgaatccggcctcccacattattcctgataccacacctgacccccatgactgtatctctctgatccacctgacattaaccccatttccccaaatttccttctttcctgttcctcaccctgatcacgcttgatttattgatggcagttccaccaggcctagtcgccacataccagcaaaggcaggctatgctatagtacaagccactagcccgcctctcagaacctctcatttcctttccatcgtggaaatctatcctcaaggaaataacttctcagtgttccatctgctattctactactcctcagggattattcaggccccctcccttccctacacatcaagctcgaggatttgcccccacccaggactggcaaactagctttactcaacatgcctgagtcaggaaactaaaatacctcttagtctaaatagacactttcactgaataagtaaaggcctttcctacagggtctgagaaggcctccgcagtcatttcttccattctgtcagacataattcctcagtttagccttcccacctcaatacagtctgataacagatgagcctttattagtcaaatcagccaagcagtttttcaggctcttagtattcagtgaaacctttatatcccttacagtcctccatcttcaagaaaggtagaatggactgaaggtcttttaaaaacacacctcaccaagctcagccatcaaaaaggactggacaatacttttatcactttcccttctcagaattcaggcctgtcctcggaatgctacaaggtacagcccatttaagctcctgtatagatgctcctttttattaggccccagtctcattccagacaccggaccaacttagactgtgccccaataaaagcttgtcatccctactgttttctgtctagtcatactcctattctccattctcaactactcatacatgccctgctcttctttacactgccagtttacactgtttatccaagccatcacagctgatatctcctcgtgctatccccaaaccgccactcttaactcttgaagtaaataaataatctttgctggcaggactatgctgaatctccttaggcactctctaatcagatgtcctaggtcctcccaattcttagaccttttatacctgtttttctccttcttattccatttagtttttcagttcatacaaaaccatatccaggccatcaccaatcattctatacaacaaatgtttcttctaacaaccccacaatatcaccccttaccacaagatctcctttcagcttaatctctcccactctaggttcccacgccgcccctaatccctcttgaagcaggcctgaggaacatcgtccactctctctccataccaccccccaaaaattttcgccgccccaacacttcaacactattttgttttatttttcttattaagaaggcaggaatgtcaggcctctgagcccaagccaagccatcacatcccctgtgacctgcacatatacgcccagagggcctgaagtaactaaagaatcacaaaagaagtgaatatgccctgccccaccttaactgatgacattccaccacaaaagaagtgtaaatggccggtccttgccttaactgatgacattaccttgtgaaagtccttttcctggctcatcctggctcaaaaagcacccccactgagcaccttgtgacccccccactcctgcccactgagcaccttgcgacccccactcctacctgccagagaacaaaccccctttgactgtaattttcctttacttacccaaatcctataaaatggccccacccttgtctccctttgctgactctcttcggcctcagcccacctgcacccaggtgaaataaacagccatgttgctcacacaaagcctgtttggtggtctcttcacacagacgcacatgaaa

SEQ ID NO: 175 - DNA, 500 bp, Homo sapiens
atggaatgagaccaccacttctcctgttgtccctcccagcttcttctccaccacctccccttttccctagtttataagacaggagaaaagtgagacagcaaaaagttagaaagaaacagaagtaagataaatagctagacgaccttggcgccaccacccggccttggtggttaaaataataataataatgttaacccctgaccaaaactacttgtgttatctgtaagttccagacattgtatgagaaagcgctgtaaaactttttgttctgttagccgatgcatgtagcccccagtcacgttccccacgcttgctccatctatcacaaccgtttcacatggaccccccccttcaagttgtaagcccttaaaagggctaggaatttcttttttggggagctcggcttttaagatgcgagtctgccaacgctctcggccgaataaacttcttccttctttaatccagtgtcaggagttttgtctgcggctcgtcctgctaca

SEQ ID NO: 176 - DNA, 7833 bp, Homo sapiens
gtcaggcctctgagcccaagccaagccatcgcatcccctgtgacttgcacatatacacccagatggcctgaagtaactgaagatccacaaaagaagtaaaaatagccttaactgatgacattccaccattgtgatttgttcctgccccaccctaactgatcaatgtactttgtaatctcccccacccttaagaaggttctctgtaattctcctcacccttgagaatgtactttgtgagatccacccctgcccgcaaaacattgctcttaacttcaccgcctaacccaaaacctataagaactaatgataatccatctcccttcactgactctcttttcggactcagcccacctgcacccaggtgaaataaacagctatgttgctcacacaaagcctgtttggtggtctcttcacaaggacgcacatgaaatttggtgccgtgactcggaccaggaccgcaccctgtagcctttctgtccaaacaacttgaccttactgttttagcctaaccctcatgtctgcatgcagtggctgccactgctttaatacttttagaggccctaaaaatcacaaactatgctcaactcactctctacatttctcataacttccaaaatctattttcttcctcatacctgacgcatatactttctgctccccggctccttcagctgtactcactctttgttaagtcccacaattactattgttcctggcccggacttcaatctggcctcccacattattcctgataccacacctgacccccatgactgtatctctctgatccacctgatattcaccccatttccccatatttccttctctccgtgtctctaccccttctctgcttttctgggggaggggcaagtacccctcaatcccttctccttcacccttagtggcaagtcctgcttttctggggaaggggcaagtaccccaaccccttctctccttgtctctaccccttctctgcttttctggggaaggggcaagtaccccaaccccttctctccatgtctataccccttctctgattttctggggcaggggaaagaacccctcaaccccttctccttcacccttagtggcaagtcccgcttttctggggaagaggcaagtaccccaaccccttctctccttgtctctaccccttctctgattttctggggcaggggcaagaacccctcaactccttctccttcaccctcagcggcaagtcccacttttctgggggaggggcaagtactccaaccccttctctctgtgtctctatcccttctctgcttttctgggggagaggcaagtaccccaacctcgtatctctgcaccccgatcccttatttctgcaccctgacctcgtatctctgcaccccaaccccttctctgcttttctggagggcaagaaacccccaccccttctccgtgtctctactcttttctctgggcttgcctccttcacgatgggtaagcttccaccttccattcctctttcttctcccttagcctgtgttcttaagaacttaaaacctcttcaactttcacctgacctaaaacctaaatgccttattttcttctgcaatgccgcttgaccccaatacaaactcgacagtagtcccaaatagccagaaaactgcactttgaatttttccatcctgcaagatctaaataattcttctcgtaaaataggcaaacggtctgaggtgcctgaagtccaggcattcttttacacatcagtccctctctagtctctgttccaatgcaactcatcccaaatcttccttctttccctcctgcctgtcccctcagtcccaaccccaagcgtcgctgagtctttctaatcttccttttctacagactcttctgacctctcccctcctcgccaggccgagctaggtcccaattcttcctcagcctccgctcctccaccctataatccttttatcacctcccctcctcacacccagtctggtttacagtttcgttccgtgactagccctcccccacctgcccagcaatttactcttaaaaaggtggctggagctaaagccatagtcaaggttaatgctcctttttctttatcccaaatcagatagtgtttaggctctttttcatcaaacataaaaaacccagcccagttcatggctcattcagcagcaaccctgagacgctttacagccctagaccctaaaaggtcaaaaggccgtcttattctcaatatacattttattacccaatctgctcccgacattaaataaactccaaaaattaaattccggccctcaaaccccacaacaggatttaattaacctcgccttcaaggtgtacaataatagaaaaaagttgcaattccttgcctccactgtgagacaaaccccagccacatctccagcacacaagaacttccaaatgcctgaactgcagcagccaggcgttcctccagaacctcctcccccaggagcttgctacacatgccggaaatctggccactgggccaaggaatgcccgcagcctgggattcctcctaagccgcgtcccatctgtgcaggaccccactgaaaattggactgttcaactcacctggcagccactcccacagcccctggaactctggcccaaggctctctgactccttcccagatcttctcggcttagcggctgaagactgacgctgcccaatcacctcggaagccccctagaccatcacaggtgccgagcttccagtaactcacagtggaaggtaagtccatccccttcttaatcaatatggaagctacccactccacattaccttcttttcaagggcctgtttcccttgcttccataactgttgtgggtattgacggccaggcttctaaacctcttaaaactccccaactctggtgccagctgagacaatactcttttaagcactccttttagttatccccacctgcccagttcccttattaggccgagacactttaactaaattatctgcttccctgactattccgggattacagctacatctcattgccacctttcttcccaatccaaagccttctttgcgtcctcctcttgtattccccgaccttaacccacaactataagatacccctactccctccttggtgaccgatcatgcaccccttaccatctctttaaaacctaatcacccttaccccactcaatgccaatatcccatcccacagcacactttaaaaggattaaagcctgttatcactcgcctgctacagcataggcttctaaaacctataaactctccttacaattccccaattttacctgtccaaaaacagaacaagtcttacagattagttcaggatctgcgccttatcaaccaaattgttttgcctatccaccccgtggtgccaaacccatatactctcctatcctcaatacctccctctactacccattattctgttctagatctcaaacatgctttctttttttttgaaactttttattttttttggaaactttttactttgatatgatttatttatttatttatttttttttttttattgatcattcttgggtgtttctcgcagagggggatttggcagggccacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcgtctgtttaacaaagcacatcttgcaccgcccttaatccatttaaccctgagtggacatagcacatgtttcagagagcacagggttgggggtaaggtcaccgatcaacaggatcccaaggcagaagaatttttcttagtacagaacaaaatgaaaagtctcccatgtctacctctttctacacagacacagcaaccatccgatttctcaatcttttccccacctttcccccctttctattccacaaaaccgccattgtcatcccggcccgttctcaatgagctgttgggtacacctcccagacggggtggtggccgggcagaggggctcctcacttcccagtaggggcggccgggcagaggcacccctcacctcccggacggggcgactggccgggcggggggctgacccccccatctccctcccggacggggcggctggccaggcagaggggctcacttcccagtaggggtggccgggcagaggcgcccctcacctcccggagggggcggctggccgggcggggggctgatccccccacctccctcccggacggggcggctggccgggcggggggctgacccccccacctccctcctggacggggtggctgccgggcggagacgctcctcacttcccagacggggtggctgccgggcggaggggctcctcacttctcagacggggcggctgctgggcggaggggctcctcacttctcagacagggcggttgccaggcagagggtctcctcacttctcagacggggcggccgggcagagacgctcctcacatcccggacggggcgacagggcagaggcgctccccacatctcagatgatgggtggccgggcagagacgctcctcacttcctagatgggatggcggcctggcagagacgctcctcactttccagactgggcagccaggcagaggggctcctcacatcccagacgatgggcggccaggcagagatgctcctcacttcccagacggggtggcggccgggcagaggctgcaatctcggcactttgggaggccaaggcaggctgctgggaggtggatgttgtagcgagccgagatcatgccactgcactccagcctgggcaccattgagcactgagtgaaggagactccgtctgcaatcccggcacctcgggaggccgaggctggcggatcactcgcggtcaggagctggagaccagcccggccaacacaacgaaaccccgtctccacccaaaaaatacgaaaaccagtcaggcgtggcggcgcgcgcctgcaattgcaggcactcagcaggctgaggcaggagaatcaggcagggaggttgcagtgagccgagatggcagcagtacagtccagcttcggctctgcatcagagggagaccgtggaaagaggggagggggagggggagagggagagggagagggagagggagagggagagggagagggcatgctttctttactattcctttgcacccttcatcccagcctctctttgctttcacttggactaaccctgacacccatcagtcccagcagcttacctgggctgtactgccgcaaggtttcagggacagccctcattacttcagccaagctctgtctcatgatttagtttctttccacccctccgcttctcaccttattcagtatattgatgaccttcttctttgtagcccctcctttgaatcttctcaacaagacacacttctgctccttcagcatttattctccaaaggatagcgggtattcccctccaaagctcaaattttttccccatccattacctacctcggcataattcttcataaaaacacatgtgctctcccttctgatcatgtccgattaatctcccaaacctcaatcccttacaaaacaacaactccttttcttcctaggcatggttagtgtggtcagaattcttacacaagagccaggaccacaccctgtagcctttctgtccaaacaacttgaccttactgttttagcctagccatcatgtctccgtgcagcggctgccactgctttaatacttttagaggccctaaaaatcacgaactgtgctcaactcactctctgcatttctcataacttctgaaatctactttcttcctcatacctgatgcatatactttctgctccctggctccttcagctgtactcactctttgttaagtcccacaattaccattgttcctggcccggacttcaatctggcctcccacattattcctgataccacacctgacccccatgactgtatctctctgatccacctgatattcacccgatttccccatatttccttcttttctgttcctcaccctgatcacgcttgatttattgatggcagttccaccaggcctaatcgccacacaccagcaaaggcaggctatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagcttgaagatttgcccccacccaggactggcaaattagctttactcaacatgccctgaatcaggaaactaaaatacctcttagtctaactagacactttcactgaataagtaaagacctgtcctacagggtctgagaaggccaccgcagtcatttcttctcttctgtcagacataattcctcagtttagccttcccacctctatacagtctgataaaagaccagcctttattagtcaaatcagccaagcagtttttcaggctcttagtactcagtgaaacctttatatcccttacggtcctcagtcttcaagaaaagtagaacagactaaaggtcttttaaaaacacacctcaccaagctcagccaccaacttaaaaaggactggataatacttttaccactttcccttctcagaagtcagacctgtcctcagaatgctacaaggtgcagcccatttgagctcctgtatagacgctcctttttattaggccccagtctcattcgacaccagaccaacttagactgtgaccccaaaaaacttgtcatccctactatcttctctctagtcatactcctattcaccgttctcaactactcatacatgccctgctcttgtttacactgctggtttacactgtttctccaagccatcacagctgatatctcctggtgctatccccaaactgccactctaaactctggaagtaaataaataatctttgctggcaggactatgctgaatctccttaggcactctctaatcagatgtcctaggtcctcccaattcttagaccttttatacctgtttttctccttctcttattccatttagtttctgaattcatccaaaaccgtatccaggccatcaccaataattctatatgacaaatgtttcttctaacatccccacaatatcaccccttaccacaagatctcccttcagcttaatctctcccactctaggctcccacgccacccctaatcccgcttgaagcagccctgagaaacatcacccattctctctccataccaccccccaaaaattttcaccgccctaacacttcaacactattttgttttatttttcttattaatataagaaggcaggaatgtcaggcctctgagcccaagccaagccatcgcatcccctgtgacttgcacatatacaaccagatggcctgaagtaactgaagatccacaaaagaagtaaaaatagccttaactgatgacattccaccattgtgatttgttcctgccccaccctaactgatcaatgtactttgtaatctcccccacccttaagaaggttctctgtaattctcctcacccttgagaatgtactttgtgagatccacccctgcccgcaaaacattgctcttaacttcactgcctatcccaaaacctataagaactaatgataatccatctcccttcactgactctcttttcggactcagcccacctgcacccaggtgaaataaacagccatgttgctcacacaaagcctgtttggtggtctcttcacaaggacgtgcatgaaa

SEQ ID NO: 177 - DNA, 972 bp, Homo sapiens
gtggggaaaagaaagagatatcagattgttactgtgtctgtgtaggaagaagtagacataagagactccattttgttctgtactaagaaaaattcttttgccttgagacgctgttaatctgtaaccctacccccaaccctgtgctccctaagacatgggctgtgtcaactcagggttaaatggattaagggctgttcagggtgtgctttgttaaacaaatgcttgaaggcagcatgcttgttaagagtcatcaccactccctaatctcaagtgcccagagacacactacactgcggaagactgcagggacctctgcctaggaaagccaggtattgtccaaggtttctccccatgtgatagtctgaaatacagcctcgtgggaagggaaagacctgactgtcccccagcccgacacccgtaaagggtctgtgctgaggaggattagtaaaagaggaaggaaggcctctttgcagttgagataagaggaaggcatctgtctcctgctcatccctgggcaatggaatgtctcggtgtaaagcccgattgtatatcccatctactgagataggagaaaactgccttaggactggaggtgggacatgctggcagcaatactgctctttaaggcattgagatgtttctgtatatgcacatcaaaagcacagcacttttttctttaccttgtttatgatgcagagacatttgttcacgtgtttacctgctgatcttctctccactattatcctattgtcctgccacatccccctctccggaaatgcccgataatgatcaataaatactaagggaactcagaggccagtgctggcatgggtcctccatatgctgaacgccggtcccctgggcccatttttctttctctgtactttgtctctgtgtctctttcttttccaagtctctccttccacctaacgagaaacgcccacaggtgtggaggggcaacccatcccttca

SEQ ID NO: 178 - DNA, 961 bp, Homo sapiens
gtggggaaaagcaagagagatcagattgttactgtgtctgtgtagaaagaagtagacataggagactccattttgttatgtactaagaaaaattcttctgccttgagattctgtgacctcacccccaacctcgtgctctctgaaacatgtgctgtgtcaaactcagagttaaatggattaagggcggtgcaagatgtgctttgttaaacagatgcttgaaggcagcatgctccttaagagtcatcaccactccttaatctcaagtactcagggacacaaaaactgcagaaggccgcagggacctctgcctaggaaagccaggtattgtccaaggtttctccccatgtgatagtctgaaatatggcctcgtgggaaaggaaagacctgacctgtccctcagcccgacacccataaagggtctgtgctgaggaggattagtaaaagaggaaggaatgcctcttgcagttgagacaagaggaaggcatctgtctcctgcctgtccttgggcaatggaatgtctcggtataaaacctgattgtatgctccatctactgagatagagaaaaaccgccttagggctggaagtaggacctgcaggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctcttcgagaaacacccacagatgatcaataaatactaagggaactcagaggctggcgggatcctccatatgctgaacgctggttccccgggtccccttatttctttctctatactttgtctctgtgtctttttcttttccaaatctctcgtcccaccttacaagaaacacccacagctgtggaagggcaacccacccctaca

SEQ ID NO: 179 - DNA, 5300 bp, Homo sapiens
gtcagggcctctgagcccaagccaagccactgcatcccctgtgacttgcacatataccgcccagatggcctgaagtaactgaagaatcacaaaagaagtgaaaatgccctgccccaccttaactgatgacattccaccaaaaaagaagtgtaaatggccggtccttgacttaagtgatgacattaccttgtgaaagtcctttttctggctcatcctggctcaaaaactcccccactgagcaccttgctacccccactcctgcccgccagagaacaaaccccctctgactgtaattttcctttacctgcccaaatcttataaaatggccccacccctatctccctttgctgactctcttttcggactcagcccgcctgcacccaggtgaaataaacagccatgttgctcacacaaagcctgtttggtggtctcttcacatggacgcgcatgaaatttggtgccatgactcgggtcagggaacctcccttgggagatcaatcccctgtcctcctgctctttgctccgtgagaaagatccacctacgacctcaagtcctcagaccgaccagcccaagaaacgtctcaccaatttcaaatccggtaagtggcctctttttactctcttctccaacttccctcactacccctcaaccccttctccttcacccttagcggcaagtcccgcttttctaggggacaagaacccccaatcccttatttccacgccccgacccctttcccgcttttctggagggtaagaacacttgaaccccttccctccatgtctctatgctctcttttctctgggcttgcctccttcactatgggcaaccttccaccctccattcctccttcttgtcccttagcctgtgttcttaagaacttaaaacctcttcaactctcacctgacctaaaatctaagcgtcttattttcttctgcaatgccgcttgaccccaatacaaactcgacagtagttccaaatagccggaaaacagcactttcaatttttccatcctgcaagatctaaataattcttgtcataaaatagacaaatggtctgaggtgcctgacgtccaggcattcttttacacatcagtcccttcctagtctctgtgcccaatgcaactcatcccaaatcttccttctttacctcctgcctgtcccctcagtcccaaccccaagcatcactgagtctttctaatcttccttttctacagacccgtctgacctctcccctcctcgccaggctgagctaggtcccaattcttcctcagcctctgctcctccaccctataatccttttatcacctcccatcctcacaactggtccggcttacagttacgtttcgtgactagccctcccccacctgcccagcaatttactcttaaaaaggtggctggagctaaaggcatagtcaaggttaatgctacttttctttatcagacctctcccaaatcactgagcatttaggctttttcatcaaatatgaaaaacccagcccagttcatggctcgttcggcagcaaccctgagacgctttacagccctagaccctaaaaggtcaaaaggccatcttattctcaatatacattttattacccaatctgctcccaacattaaataaaactccaaaaattagaatctggccctcaaaccccacaacaggacttaattaacctcaccttcaaggtgtacaataatagaaaaaagttgcaattccttgcctccactgtgagacaaaccccagccacatctccagcacacaagaatttccaaacgcctgaaccgcactggccaggcgttcctccagaacctcctcccccaggagcttgctacaagtgccagaaatctggccaccaggccaaggaatgccctcagcccaggattcctcctaagccgcgtcccatctgtgtaggaccccactggaaatcggactgttcaactcacctggcagccactcccagagcccctggaactctggcccaaggctctctgactccttctcggcttagcggctgaagactgatgctgcccgatcacctcagaagccctgtagaccatcacggatgccaagctttaggtaactctcacagtggaaggtaagcccatccccttcttaatcaatatggaggctacccactccacattaccttcttttcaagggtctctttcccttgcctccataactgttgtgcgtattgacagccaggcttctaaacctcttaaaactccccaactctcgtgccaacttagacaacactcttttaagcactcctttttaattatccccacctgcccagttcccttattaggctgagacactttaactaaattatctgcttccctgactgttcctggactacagctgcatctcattgccacccttctccccaacccaaagcctcctttgtgtcctcttttatccccccgaccttaacccacaagtataagacacctctactccctccttggtgacccatcatgcaccccttaccatctcattaaaacctaatcaccctcaccctgctcaaagccaagatcccatcccacagcacgctttaaaaggattaaagcctgttatcactcgcctgctacggcatggccttttaaagcctataaactctccttacaattcccccattttacctgtcctaaaaccagacaaggcttacaagttagttcagaatctgtgccttatcaaccaaattgttttgtctatccacctcgtggtgccaaacccatatactctcctatcctcaatacctccctctactacccattattctgttctggatctcaaacatgctttctttactattcctttgcacccttcatcccagcctctctttgctttcacttagactaccctgacacccatcaagctcagcaaattacctgggctgtactgccacaaggcttcacagacagcccccattacttcagtgaggcccaaatttcatcctcatctgttacctatctcggcataattctcataaaaacacacatgctttccctgctgatcgtgtccaattaatctcccaaacctcaatcccttacaaaacaacaactcctttccttcctaggcatggttagtgcagtcagaattcttacacaagagccaggaccacaccctgtaacctttctgtccaaacaacttgaccttactgttttagcctagccctcatgtctgcgtgcagtggctgccactgctttaatacttttaaaggccctaaaaatcacaaactatactcaactcactctccacatttctcataacttccaaaatctattttcttcctcatacctgacgcatatactttctgctccccagctccttcagctgtactcactctttgttaagtcccacaattaacattgttcttggcccggacctcaatctggcctcccacattattcctgataccacacctgacccccatgactgtatctctctgatccacctgacattcaccccatttccccatatttccttctttcctgttcctcaccctgatcacgcttgatttattgatggcagttccaccaggcctaatcgccacacaccagcaaaggcaggctatgctatagtacaagccactagcccgcctcttagaacctctcattgcctttccatcatggaaatctatcctcaaggaaataacttctcagtgttccatctgctattctactactcctcagggattattcaggccccctcccttccctacacatcaagcttgaagatttgcccccatccaggactggcaaattagctttactcaacatgccccgagtcagataactaaaatacctcttagtctaagtagacactttcactagataagtagaggcctttcctacagggtctgagaaggccaccacagtcatttcttcccttctgtcagacataattcctcattttagccttcccacctctatacagtctgataacagaccagcctttattagtcaaatcagccaagcagtttttcaggctcttagtattcagtgaaacctttatatcccttacagtcctcagtcttcaggaaaagtagaacagactaatggtcttttaaaaacacacctcaccaagctcagccaccagcttaaaaaggactggacaatactttaaccactttcgcttctcagaattcaggcctgtcctcggaatgctacaaggtacagcccagttaagctcctgtatagacgctcctttttattaggccccagtctcattccagacaccagaccaacttagactgtgccccaaaaaacttgtcatccctactatcttctgtctagtcatactcctattcaccgttctcaactactcatacatgccctgctcttgtttacactgccagtttacactgtttctccaagccatcacagctgatatctcctggtgctatccccaaaccgccactctaaactcttgaggtaaataaataatctttgctggcaggactatgctgaacctccttaggcactctccaatcagatgtcctgggtcctcccaattcttagaccttttatacctgtttttctctttctcttattccatttagtttttcaattcatataaaaccgtatccaggccatcaccaatcattctacacaacaaatgtttcttctaacaaccccacaatatcaccccttaccacaaaatcttccttcagcttaatctctcccaccccaggttcccacgccgcccctaatcccgctcaaagcagccctgagaaacatcgcccattctctctctccataccaccccccaaaaatttttaccgccccaatacttcaacactattttgttttatttttcttattaatataagaaggcaggaatgtcaggcctctgagcccaagccaagccattgcatcccctgtgacttgcatgtatacgcccagatggcctgaagtaactgaagaatcacaaaagaagtgaaaatgccctgccccaccttaaatgatgacattccaccacaaaagaagtgaaaatggccggtccttgccttaagtgatgacattaccttgtgaaagtccttttcctggctcatcctggctcaaaaagctcccccactgagcaccctgcgacccccactcctgcccgccagaggacaaaccccctttgactgtaattttcctttacctgcccaaatcttataaaacggccccaccccatctcccttcgctcactctcttttcggactcagcccgcctgcacccaggtgaaacaaacagccatgttgctcacacaaatcctgtttggtggtctcttcacacggacgtacatgaaa

SEQ ID NO: 180 - DNA, 8055 bp, Homo sapiens
gtcaggcctctgagcccaagccaagccatcacatcccctgtgacttgcacatatacgcccagatggcctgaagtaactgaagaatcacaaaagaagtgaatatgccctgccccaacttgatgacattccaccacaaaagaagtgaaaatggccggtccttgccttaagtgatgacattaccttgtgaaagtccttttcctggctcaaaaagctcccccactgagcaccttgcgacccccactcctgcccgccagagaacaaaccccctttgactgtaattttcctttacctacccaaatcttatagaaacggccccacccctatctcccttcgctgactctcttttcagactcagcccacctgcacccaggtgattaaaagctttattgctcacgcaaagcctgtttggtggtctcttcacacggacgcacatgaaatttggtgccgtgactcggatcggggggccttccttgggagatcaatcccctgtcctcctgctctttgctccttgaaaaagatccacctacaacctcaggtcctcagacccaccagcccaaggaacatctcaccttatatctctgcgccccaatcccttatttccgcgccctgacctcttatctctgtgccccaatcccttatttccgtaccccgacctcttatatctctgtgccccgatcccttatttccgtgccccaacctcatatctctgcaccctgatcccttatttccgtgcaccgacctcgtatctctgcgccccaacccctttcccacttttctggagggtaggaacccctgaaccgcttccctccatgtctctactctcccttttctttaaacttgcctccttcactataggcaaccttccaccctccattcctccttcttctcccttagcctgtgttctcaaaaacttaaaacctcttcaactcccacctgacctaaaacctaaatgcttattttcttctgcaatgccgcttgacccaatacaaactcaacagtagttccaaatagccagaaaacggcactttccatttttccatcctgcaagatctaaataattattgtcgtaaaataggcaaacggtctgagctgcctgacggccaggcattcttttacacatcggtcccttcctagtctctgtgcccaaagcaactcgtcccaaatcttcctcctttccctcccgcctgtcccctcagtcccaaccccaagcgtcactgagtctttctttcttttctacagatccatctgacctctcccctcctccccaggctgctcctcgccaggccaagctacgtcccaattcttcctcagcctctgctcctccaccctacaatccttttatcacctcccctcctcacacctggtccggcttacagtttcgttccgcgcctagccctcccccacctgcccagcaatttcctcttaaaaaggtggctggagccaaaggcatagtcaaggttaatgctcctttttctttatccgacctctcccaaagcagtgagcatttagactctttttcatcaaatataaaaaacccagccctgttcatggcttgttcggcagcaaccctgagacgctttacagccgtagaccctaaaaggtcaaaaggccgtcttattctcaatatacattttattacccaatctgctctcgacattaaataaaactccaaaaattaaattccggccctcaaaccccacgacaggatttaattaacctcgccttcaaggtgtacaataatagaaaaaagttacaattccttgcctccactgtgagacaaaccccagccacatctccagcacacaagaacttccaaacgcctaaaccgcagtggccaggagttcctccagaaccaccttccccaggagcttgctacaagtgccagaaatctggccaccaggccaaggaatgcccgcagcccgggattcctcctaagccgtgtcccatctgtgcgggaccccaccggaaatcggactgttcaactcacctggcagccactcccagagtccctggaactccggcccaaggctctctgactgactccttcccagatcttctcggcttagcagctgaagactgacactgccagattgcctcggaagcctacaggacagagagctctaagtaactctcacagtggagggtaagtctgtccccttcttaatcaatacagaggctacccagtccacgttaccttcttttcaagggcctgttttcctcgccccgataattgttgtgggtatcgacggccaagcttcaaaacccctgaaaactcctcaactctagtgccaacttggacaacactcctttatgcacttttttatttatccccacctgcccagttcccttattaggccgagatattttaaccaaattagctgcttccctgactattcctgggctacagccacacctcattgccaccttttccccagttcaaagcctccttcgcatctccctctcgtatccccccccaccttaacccacaagtataagatacctctattccctccttggcgaccgatcatgcaccccttacaatctcattaaaacctaatcacccttacccccctcaatgccaatatcccatcccacagcacgctttaaaaagattaaagcctgttatccctcgcctgctacagcatggtcttttaaagcctataaactctccttaccattcccccattttacctgtcctaaaaccagacaaggcttacaggttagttcagaatctgcgccttatcaaccaaattgttttgcctatccaccccatggtgccaaacccgtatcctctcctatcctcaatacctccctctacaacccattattctgttctggatctcaaacatgctttctttactattcctttgcacccttcatcccagcctctcttcgctttcacttagactgaccctgacacccattaggctcagcaaattacctgggctgtactgccgcaaggcttcacagacagaccctattacttcagtcgagcccaaatttcatcctcatctgttacctatctcagcataattctcataaaaacacacgtgctctccctgctgatcgtgtccaattattctcccaaacctcaatcccttacaaaacaacaactcctttccttcctaggcatggttagtgcggtcagaattcttacacaagagacaggaccacaccatgtagcctttctgtccaaataacttaaccttactgttttagcctagccctcatgtctgcgtgcagcggctgccgctgctttaatacttttagaggccctaaaaatcacaaactatgctcaactcactctctacatttctcataacttccaaaatctattttcttcctcatacctgatgcatatactttctgctccccggctccttcagctgtactcactctttgttaagtcccacaattaccattgttcctggcccggacttcaatccagcctcccacattattcctgataccacacctgacccccatgactgtatctctctgatccacctgacattcaccccatttccccatatttccttctttcctgttcctcaccctgaccacgcttgatttattgatggcagttccaccaggcctaatcgccactcaccagcaaaggcaggctatgctatagtatcttccacatctatccttgaggctaccgctctgccccactccactacctctcagcaagccgaactagttgccttaactcaagccctcactcttgcaaaaggactacgtgtcaatatctatactgattctaaatatgcctttcatattctgcaccaccctgcggtcatatgggctgaaagaggtttcctcactacacaagggtcctccatcattaatgcctctttaataaaaactctgctcaaggccgctttacttccaaaggaagctggggtcattcactgcaaggggcatcaaaagtcatcagatcccattgctctaggcaacgcttatgctgataaggtggctagacaaacagctagctttccaacttctgtttctgacagcaacgcttatgctgataaggtggctagacaagcagctagctttccaacttctacctctgacagcaatgcttatgctgataaggtggctagacaagcaactagctctccaacttctgtccctcacagccagtttttctccttcacatcggtcactcccacctactcccctgttgaaacctccacctatcgatctcttcccacacaaggcaaatggttcttagaccaaggaaaatatctccttccagcctcacaggcccattctattctgtcatcatttcataacctcttccatgtaggttacaagccactagcccgtcccttaggacctctcatttcctttccatcatggaaatctatcctcaaggagatcacttctcagtgttccatctgctattctactacctaccccccagggattgttcaggcctcctccctttcctacacatcaagctcagggatttgcccccgcccaggactggcaaattgactttactcacaagccttgagtcagaaaactaaaatatctcttagtctgggtagacactttcactggatgggtagatgcctttcccacagggtctgagaaggccaccgctgtcatttctgcccttctgtcagacataattcctcggtttggccttcccacctctatacagtctgataacgggccagcctttactagtcaaatcacccaagcagtttctcaggctcttggtattcagtggaaccttcatatcgcttaccatcctcagtcttcaggaaaggtagaatggactaatggtcttttaaagacacacctcaccaagctcagcctccaacttaaaaaggactggacagtacttttacctcttgcccttctcagaattagagcctgtcctcgagatgctacagggtacagtccatttgaacttttatatggacgcactttcttgcttgggcccaacctcttcacagacaccagccctctaggtgactatcttccagtcctccaacaggctagacaggaaattccccagactgctaatcttctcttgcttactccagatccccagccatatgaagacaccctagctggatgatcagttcttgttaagaatctgaccccttaaactctacaacctcgatggaccggaccctacttagtcatctatagtaccccaactgctgtctgccttcagggtcctccccactaggttcaccattccagaataaagctctgtccatcggacagccagcctaatccctcctcttcctcctggaagtcgcaagtactctcccctacttcccttaaactcactcgtatttctgaagaagagtaataacccttatgagcctaatacatcccttcattctcttaggtctgtttgtccttaccctactttttgcaacagggctttacgaagtcacccccaccacttaggacgagccccaaaaaacttgtcatccctactattttctgtctaatcatactcctattctccgttctcaactacttacaaatgccctactcttgtttacactgccggtttacactgtttcttcaagccatcacagctgatatctcttggtgctatccccaaaccgccactcttaattccctcttagagtgggtagatgatctttgctggcagggcaccctccaatacttccaccctgatgaagttctattctttacttttatacttactcttattctcattcccattcttatgccaccctttacctctccccagctatctccaccacactatcaaccttacccattctctcctagccgcttctaatccctccttagtgaacaactgctggctttgcgtttccctttcttccagtgcctacacagctgtccccaccttacagacagactgggcaacatctcctgtctccttacacctctgaacctcctttaacagccctcacctttaccctcctgaagaactcatttactttctagacaggtccagcaagacttccccagacctttcacatcagcaagttgccgccctcctccgcacttatttaaaaaacctttctccttatattaactctactccccccatatttggacctctcacaacacaaactactattcctctggctgcccctttatgtatctctcggcaaagacccactggaattcccctaggcaatctttcaccttctcgatgttcctttactcttcatctccgaagcccaactacacacatcactgaaacaattggagccttccagctccacattacagacaaaccctctatcaatactgacaaactcaaaaacattagcagtaattattgtttaggaagacacttactctgtatttcactccatccttgactactttcccttgctcatcagactctcctcccaggccctcttcttgtttacttataccgagccccgaaaataacagtgaaaggttgctcgtagatactcaacgttttctcatacaccatgaaaactgaacctcctcctctatgcagttaccccatcagtccccattacaacctctgacagctgccgccctagctggatccctaggagtctgggtacaagacacccctttcagcactccttctcacctttttactttacatctccagttttgcctcgcacaaggtctcttcttcctctgtggatcctctacctacatgtgtctacctgctaattggacaggcacattcacactagttttccttacccctaaaatacaatttgcaaatgggaccgaagagctccctgttcccctcatgacaccaacacgacaaaaaaagagttattctactaattcccttgatggtcggtttaggactttctgcctccactattgctctaggtactgggatagcaggcatttcaacctctgtcacgaccttccgtagcctgtctaatgacttctctgctagtatcacagacatatcacaacttaatcagtcctccaggcccaagttgactctttagctgcagttgtcctccaaaacggccgaggtcttgacttactcactgctgaaaaaggaggactctgtatattcttaaatgaagagtgttgtttttacctaaatcaatctggcctggtgtatgacaacataaaaaaactcaaggatagagcccaaaaacttgccaaccaagcaagtaattatgctgaatccccttgggcactctctaattggatatcctgggtcctcccaattcttagtcctttaatacccatttttctccttcttttatttggaccttgtatcttccatttagtttctcagttcatccaaaactgtatccaggccatcaccaatcattctatatgacaaatatttcttctaacaaccccacaatatcaccccttaccacaagacctcccttcagcttaatctctcccactctaggttctcacgccacccctaatcccgcttgaagcagccctgagaaacatcgcccattctctctccataccaccccccccaaaaaattttcgctgccccaacacttcaacactattttgttttatttttcttattaatataagaaggcaggaatgtcaggcctctgagcccaagccaagccatcacatcccctgtgacttgcacatatacgcccagatggcctgaagtaactgaagaatcacaaaagaagtgaatatgccctgccccaccttaactgatgacattccaccacaaaagaagtgtaaatggccggtccttgccttaactgatgatattctaccacaaaagaagtgaaaatggccggtccttgccttaagtgatgacattaccttgtaaaagtccttttcctggctcatcctggctcaaaaagctcccccactgagcaccttgcaacccccactcctgcccaccagggaacaaaccccctttgactgtaattttcctttacctacccaaatcttataaaaacggccccacccctatctcccttcgctgactctcttttcagactcagcccgcctgcacccaggtgattaaaagctttattgctcacacaaagcctgtctgctggtctcttcacatggacgtgcatgaaa

SEQ ID NO: 181 - DNA, 966 bp, Homo sapiens
gtggggaaaagagagagagatcacattgttactgtgtctgtgtagaaagaagtagacataggagactccattttgttctgtactaagaaaaattcttctgccttgagatgctgttaatctaaccctagccccaaccctgtgctccctgagacatatgctgtgtcaactcagggttaaatggattaagggctgtgcaagatgtgctttgttaaagaaatgcttgaaggcagcatgctcgttaagagtcatctccactccctaatctcaagtactcagggacacaaaacactgaggaaggccacagggacctctgcctaggaaagccaggtattgtccaaggtttctccccatgtgatagtctgaaatgtggcctcgtgggaagggaaagacctgaccgtcccccagcccgacacccgtaaagggtctgtgctgaggaggattagtaaaagaggaaggaacgcctctttgcagttgagacaagaggaaggcatctgtctcctgctcgtccctgggcaatggaatgtctcagtgtaaaacccgattgtatattccatctactgagataggggaaaactgccttagggctggaggtgggacatgctggcagcaatactgctcttcaagtcattgagatgtttatgtgtatgcatatctaaagcacagcacttaattctttaccttgtttatgatgcagagacctttgttcacgtgtttacctgctgaccttctctccactattatcctttgaccctgccacatccccctctccgagaaacacccaataatgatcaataaatactaagggaactcagaggccggtgggatcctccgtatgctgaacaccggtcccctggacccctttttttctttctctatactttgtctctgtgtctctttcttttccaagtctctcattccacctaacgagaaacaaccacaggtgtggaggggcagcccaacccttca

SEQ ID NO: 182 - DNA, 796 bp, Homo sapiens
ggaatgagaccaccacttctcctgttgtccttcccagcttctcccccacctccccttttccctagtttataagacaggagaaaagggagaaagcaaaaagttggaaagaaacagaagtaagataaatagcgagacgaccttggcgccaccacctggccctggtagttaaaataataataataacattaggccaggcgcggtggctcacgcctgtaatcccagcactttgggaggccgaggcgggcggatcacggggtcaggagatcgagaccatcctggctaacacggtgaaaccctgtctctactaaaaacacaaaaaattagcggggcgtggttgcaggcacctgtagtcccagctactcaggaggctgaggcaggagaatggtgtgaacccaggaggcggagcttgcagtgagccgagatcgcgccactgcactccagcctaggtgacagagcaagactccgtctcaaaaaataataataataataacccctgaccaaaactactggtgttacctgtaaattccagacattgtatgagaaagcactgtgaaactttttgttctgtgagctgatgtatgtagcccccagtcacgttcctcacgcttacttgagctatcatgaccctttcacggggaccccttagagttgtaagctcttaaaagggctaggaatttctttttcagggagctcgcctcttaagacatgagtctgctgacggtcccagcctaataaaaacctcttccttctttaatccggtgtctgggttgttttgactgcggctcgtcctgctaca

SEQ ID NO: 183 - DNA, 5246 bp, Homo sapiens
gtcaggcctctgagcccaagcctgcacgtatatatccagatggcctgaagcaactgaagaatcacaaaagaagtgaaaatggcctgttcctgccttaactgattacattaccttgtgaaatgtcctagctcagaagctcccccaccgagcaccttgtgaccccagcccctgcccgcaagagaacaaccccctttgactgtaattttccactacctacctaaatcctataaaactgccccacccctaactccctttgctgactcctttttcggactcagcccaactgcgcccaggtgaaataaacagccttgttgctcacacaaagcctgtttggtggtctcttcacacggacgagtgtgacatttggtgccgaagacccgggacaggaggactcctttgggagaccagtcccctgtcctcgccctcactccatgaggagatccacctatgacctcgggtcctcagaccaaccagcccaaggaacatctcaccaatttcaaatcgggtaagtggtctttttactctcttctccagcctctcttgccacccttcagtctccctctctcgctacccttcaatctctctgtccttccaattctagttctttttcctctctagtagagacaaaggagacacattttatccatggacccagaactccggcgccagtcatgaactcaggaagacagtcttcccttggtgtttaatcactgcggggacacctgcctgattattcacccacactccattggtgtctgatcaccgcagggatgcctaccttggtcattcacccacattcccttggtggcaagtcaattgcagggacgcctgctttggctgtggctgctcgcccacattgcagcccagggctgctcaccaccccccttctccatgtctctaccctctattttctcggggcttgccttcttcactatgggcaaccttccaccctccattccctcttcttatcccttagcctgtgttctcaaaaacttaaaacctcttcaactctcgcctgacctaaaacctaagcgtcttattttcttctgcaacactgcttggccccaatacaaactcaataatggttctaaatagccagaaaacggcacttttgatttctccattttacaagacctggatgattttggtcaaaaaatgggcaaatgggtctgaggtgcctgacgtccaggcattcttttacacattgatccctccttagtctctgctcccagtgcgacttgtcccaaatctttcttctttctctcctgttccttcagtctccatcccaagctctgagtcctttgaatcctccttttctacggacctatctgacctctcccctcctccccaggctgctccttgccacgccgagccaggtcccaattcttcctcagcctctgctctcccaccctataatccttttatcacctcccctcctcacacctggtccagcttatagttttgttctgtgactagccctccccgacctgcccaacaatttcctcttaaagaggtggctggagctgaaggcatagccaaggttaattctcctttttctttatctgacctctcccaaatcagttagtggttaggctctttttcatcaaatataaaaatccagcctagttcatgtcccgtttggcaacaacccttagatgctttactgccctagacccagaagggccagaaagccatcttattctcaatatgcattttattacccaacctgctcctgacattagaaaaagctccaaaaattagattccggccctcaaaccccacaacaggacttaattaacctctccttcaatgtggacaataatggagtagaggcagccaagtagcaacgtatttctgagttgcaattacttgcctccactgtgagagaaaccccagccacatctccagcacacaagaacttcaaaacacctgaactgcagcagccaggcgttcctccaggactgccacccccaggatcttgcttcaagtgccggaaatctggccactgggccaaggaatgcccgcagcccgggattcctcctaagccatgtcccatctgtgcgggaccccactggaaattggactgtccaactcgcctggcagccactcccagatcccctggaactctggcccaaggctctctgactgactccttcccagatattcgtggcttagcagttgaagactgacattgcctaatcgcctcggaaacctcctggaccatcacagacactttgggtaactcttacagtggagggtaagtccgtccccttcttaatcaatatggaggctacccactccacattaccttctttttaagggactgtttcccttgcctccataactgttgtgggtattgacagcaaggcttctaaaccccttaaaactccccaactctggtgccaacttggacaacattcttttatgcactcttttttagttatccccacctgcccagctcccttattagattgagacattttaactaaattatccgcttccctgactattcctaggctacagccacacctcattgctgccgctttaatacttttagaggccctaaaaatcacaagctatgctccactaaccctctacagttcccataactttcaaaatctattttcctcctcacacttcctgccccctggctccttcagctgtacttactctttcttgagtctcccacagttaccgttgttcctggcctggacttcaatccggcctcccacattattcctgataccacatctgacccccatgactgtatctctctgatccacctggcattcactccatttccccatatttccttctttcctgttcttcaccctgatcacacttgatggcagttccaccaggcctaatcgccaatcactggcaaaggcaggctaagctatagtgtcttccacatctatccttgaggctactgctctgcccccctccactacctctcagcaagccaaactcattgccttaactcaggccctcactcttgcaaagggactatgtgttaatatttatactgactttaaatatgccttccatatcctgcactaccatgctgttatatgagcagaaaaaagtttccccactacacaaaggtcctccataattaatgcctccttaataaaaactcttcttaaagctgctctacttccaaaaaagctagtcattcactgcaagggccatcaaaaggcatcagatcccatcgctcaaggcaacacttatgctaataagataactaaaaaagcagctagcattccaacttctgtccctcactgccagtttttctccttttcattggtcactcccacctactcccccgctgaaacttccacctatcaatctcttcccacacaaggcaaatggttcttggaccaaggaaaatatttgcttccagccttacaggcccattctattctgtcatcatttcataacttcttccatgtaggttacaagctgctagcccgcctcttagaacctctcatttcctttctatcgtggaactctatcctcaaggaaatcacttctcagtgttccatctgctattctactacttctcagggattgttcaggccccctcccttccctacacatcaagctcagggatttgcccctgcccaggactggcaaattgactttactcacatgccctgagtcaggaaactaaaatacctcttggtctgggtagacactttcactggatgggtagagacatttcccacagggtctgagaagtccactgtggtcatttcttcccttctgtcagacacaattcctcggtttggccttcccacctctatacagtctgataacggaccggcctttattagtcaaatcacccaagcagtttctcaggctcctggtattcagtggaaccttcataccccttcccatcctcaatcttcaggaaaggtaaaatggactaatggtcttttaaaaacacacctcaccaagctcagcctccaacttaaaaaggactggacaatacttttaccacttgcccttctcagaatttgggcctgtcctcgggatgctacagggtacagcccatttgagctcctgtatggacactcctttttattaggccccagtctcattccagacaccagcccaacttggactgcaccccaaaaacttgtcatccctactatcttctgtctagtcatactcctattcaccattctcaactactcataaatgccctgcccttgtttacactcccagtttacacttttcctccaaaccatcataactggtatctcctggttttatctcaaaccaccacccttaaatctctcttgaagtggataaaagatcttcagtggcaaggcacagtccggtactttcaccctgatgaagtcctattctttacttttttactcactcttattctcgttcccattcttatgccaccctctacctctccccagctatctccaccacactatcaatctcactctctcctagccgtttctaatccttctttaacaaacaattgctggctttgcatttctatttcctccaaaatcaccgagacttccgcttactcactgcttaaaaaaaggggactctatatttttaaatgaagagtgttgttttcacctaaatcaatctggcctggtatgtgacaacataaaaaaactcaaggatagagccccaaaactgaccaaccaagcaataatcacgctgaacccccttaggcactctaattagatgtcctgggtcctcccaattcttagtcctttaatacctgtttttctccttctcttattcggaccttgtgtcttctgtttagtttctcaattcatacaaaactgtatccaggccatcaccaatcattctgtacaacaaatattgcttctaacaaccccacaatatcaccccttaccacaaaatcttccttcagcttaatctctcccactctaggttcccacgctgcccctaatcctgctcgaagcagccctgagaaacattgcccattatctctctataccaccccccaaaatttttgccaccccaacacttcgccactatcttgttttgtttttcttattaatataagaagacaggagtgtcgggcctcctgacactacctactcaaatcctataaaactgccccacccctaactccctttgctgacatctttttcggactcagcccacctgcacccaggtgaaataaacagccttgttgcacacacaaagcctgtttggtggtcacttcacccagacacgcgtga

SEQ ID NO: 184 - DNA, 751 bp, Homo sapiens
gagagaccagactagctggatttcctaggctgactaagaattcctaagcctagctggggaagttgactgcacctacctttaaacatggggcttgtaactcagctcacacccaaccagtcaggtagtaaagagggctcactaaaatacaaattaggctaaaagcaggagacaaagaaatagtcaaatcatatatcacctgagagcacagggggagggacagtgattgggatataaacccaggcattggtttatatccaatgggcgaccccttttgggtcccctcccattgtgtgagagctctgttttcactcttattaaatcttgtaactgcacactcttctggtcggtgtttgttcaggctcaagcttagctttcacttaccatccagtccagcactgctggatgctgtgacccaccgttgactcccacccctccagatccagcagggtttctgctgtgaggcacccattgctgctcctgattaggctaaaggctcaccattgttcctgcatggctaagtgcccgggttcgtcctactcaaactgaacactagtcgcagggtcccacgattctcttccgtgacccacagcttctaatagagctataacacccaccgcatggcccaagttccattccttggaatctgtgaggccaagaaccccagatgagagaacaaaaaccttgcctccatcttgggcgtggcccacctccatcttgggagctctaagaacaaagacctactgataacgtt

SEQ ID NO: 185 - DNA, 327 bp, Homo sapiens
tgggtcaggcacaaagtaagcccaccccaccaggaactatgttgaaaaatttcaagaaaggatttaagggagattatggtgttactctgacaccaggaaaagttagaactttatgtgaaatagactggccagcattagaggtggatttcccatcagaagtaagccttgacgggtccgttgtttcaaaggtatggcacaaggtaacctgtaagccagggcacgcaaaccagttcctgtacatagacacttggttacagctggttttagatccgcctcacagtggttgagagaacagcagcataagcagctgacagaggcaaggaaaga

SEQ ID NO: 186 - DNA, 4627 bp, Homo sapiens
gtcaggcctctgagcccaagctaagccatcatatcccctgtgacctgcacatccagacggcctgaagtaactgaagaatcacaaaagaagtgaaaatagcctgttcctgccttagctgatgacgttccaccacaaaagaagtgaaaatggcctgttcctgccttaactgattatattatcttgtgaaattccttctcctggctcgtcctggctcaaaagctcccccactgagcaccttgtgacccccatccctgcccaccagagaacaacccccctttgactaattttcctttacctgcccaaatcctataaaacagccccatccctatctcccttcgctgactctcttttcggactcagcccacctgcacccaggtgaaataaacagccttgttgctcacacaaagcctgtttggtggtcccttcacatggacgtgagtgaaatttggtgccctgactcggatcagcggacctcccttgggagatcaatcccctgtcctcctgctctttgctccgtgagaaagatccacctacgacctctggtcctcagactaaccagcccaaggaacatctcaccaattttaaatcaggtaagcggcctctttttactctcttctccaacctctctcattatccctcaacctctttctcctttcaatcttggtgccacacttcaatttctcccttctcttaatttcagttcctttccttttctggtagagacaaaggagacacgttttatccatggacccaaaactccggcaccagtcacagactcgggaaggcagtcttcccttggtgtttaatcattgcagggacacctgcctgattattcacccacatttaattggtgtctgatcactgcagggatgcctgccttggtcattcacccacattcccttggtggcaagtcaattgcggggacgcctgctttggctgctcactcacattgcagcccagggctgctcaccccaccccttctctccgtgtctctaccccttctccactttcctggggggcaagcaccccccaccccttctctctgtgtctctccccaccccttctccactttcctgggaggcaagcaccccccaccccttctctccatgtctctacccttctctttaaacttgcctccttcgctatgggcaaccttccaccctccattcctccttcttctcccttagcctgtgttctcaagaacttaaaacctcttcaactctcacctgacctaaaatctaagcatcttattttctactgtaatgtcacttgggcctgatacaaactcgagagtagttccaatagtcagagaatggcactttcaatttttccatcctataagatctagataattcttgtcataaaatgggcaaacggtctgagatgcctgacgtccaggcatttttttacacatcagtccctccctagtctctgttcccaatgcagcttgtcccaaatccttcttttcctcccgactgtcccctcagtcccaaccccaagcgtcgctgagactttctgatcttccttttctacagacccatctgacctctcccctcctccccaggctgctcctcaccaggccaagccaggtcctaatttttcctcggcctccgctcccccaccctataatccttttagcacctcccctcctcacgcctggtccggcttagtttccttccgcaactagctctcccccacctgcccagcaatttcctcttaaaaaggtggctggagctggccaggtgcagtgagtcagacctgtaatcccagcactttgggaggctgaggcaggcagataacaaggtcaggagattgagaccatgctgactaacacggtgaaaccccatctctactaaaaatacaaaaacttagccaggcatggtggcaggtgcctgtagtcccagctactcgggaggctgaggcaggagaatggcgtgaacctggaaggcagagcttgcagtgagccgagatcgtgtcactgcactccagcctgggcggcagagcaagactccatctcaaaaaaaaaaaaaaaaaaagggggctgccagctaaaggcatagtcaacgttaatgctctcttttctttatccgacctctcccaaatcagatagcgtttaggctctttttcatcaaatataaaaacccagcccagtccatggcccatttggcaacaacccttagatgttttactgccctagacccagaagggccagaaggccatcttattctcaacacgcattttattacccaacccactcccgacagtagaaaaagctccaaaaattagattccagtcctcaaaccccacaacaggacttaattaacctcgccttcaaggtgtacaataataaagtagaggcagccaagtagcaatgtatttctgagttgcaattccttgcctccactgtgagacaaaccccagccacatctccagcacacaagaacaccaaacacctgaaccacagctgccaggggttcctccaaaccctcttaccccaggagcttgctacaagtgccagaaatctggccactgggccaaggaatgcctgcagcccaggacccctcctaagctgtgtcccatctgtgtggaaccccactgaaaataggactgttcagctcgcctggcagccactcccagagcccctggaactctggcccaaggctctctgactgactccttcccagatcttctcagcttagtggctgaagactgatactgcccgatcacctcagaagcctacaggaccatcacagacgctttgggtaacttttacagtggagggtaagtctgtccccttcttaatcaatactgaggctaccaactccacattaccttcttttcaaggactgtttcccttgcccccataattgttgtgggtattgacggccaggcttctaaacctcttaaaactccccaactctggtgccaacttggacaatattcttttatacattcctttttatttaaccccacctgcccagttcccttattaggccgagacattttaaccaaattatctgcttcccttattattcctggactacagccacatctcattgccacccttcttcccaacccaaagcctccttcgtgtcttcctctcgtatccccccaccttaacccacaagtataggacacctctactccctccttggcaatggatgatgcaccccttaccatcccattaaaacctaatcacccttaccccactcaacgccagtatcccatcccacagcatgctttaaaaggattaaagcctgttatcactcccctgttacagcatggccttttaaagcctataaactctccttacaattccccattttacctgtccaaaaaccggacaagccttacaggtttagttcaggatctgcaccttatcaaccaaattgttttacctatccacctcatggtgacaaacccatatactctcctatcctcaatacctccctccacagcccattcttctgttctggatctcaaacatgctttctttactattcctttgcacccttcatcccagcctctcttcgctttcacttggactgaccctgacacccatcaggctcagcaaattacctgggctgtactgctacaaggcttcacagacagcccccattacttcagtcaagcccaaatttcttcctcatctgttacctatctcagcataattctcataaaaacacatgtgctctccctgctgatcgtgtctgactaatctcccaaaccccaatcccctctacagaacaacaactcctttcctttcctaggcatggttagtgtggtcagaattcttacccaagagtcgggaccgcgccctgtagcctttctgtccaacttgaccttactggtttagcctagccttcatgtctgcatgcagcagctgccgctgctttaatgcttttagaggccctcaaaatcacaaactatgctcaactcactctctacagttcccataacttccaaaatctattttcttcctcccacctggggcatataccttctgctccctggcttcttcagctatactcactctttgttgagtcttccacaattaccattgttcctggcctggacttcaatccagcctcccacattattcctgataccacacctgacccccgtgactgtatctctctgatccacctgacattcactccatttccccatattctttcctcttcctcaccctgatcacacttggtttattgacggcagttccaccaggcctaattgccactcaccagcaaaggcaggctatgctatagtatcttccacatgtatgattgaggctaccgctctgcccccttccactacctctcagcaagctgaactcattgccttaacttgggccctcactcttgcaaagggactacatgtcaatatttatactaactctaaatatgccttccatatcctgcaccaccatgctgttatatgggctgaaaggggtttcctcactactcaagggtcctccatcattaatccctctttaataaaaatgcttctcaaagctgctttacttccaaaggaagctggagtcattcactgcaaaggccatcaaaaggcatcagatccatggctcaggacaaagcttctgctgataaagtagctaaaaaagcagcta

SEQ ID NO: 187 - DNA, 1144 bp, Homo sapiens
cccaggacagggggactccttctggagacctgtcccatgtccttgccctctctccatgaggagatccacctatgacctcgggtcctcagaccagcccaaggagcatctcaccaatttcaaatcaggtaactggtcctttatactctcttctccagcctctcttgctacccttcaatttctctctcctttcaatttcagctccttttcctctctagtagagacaagggagacacattttttctgtggattcaaaaactccaatgtcagtcacggacccgggaagacagtcttcccttggtgtctgatcattgcagggacaactgctttgatcactgacccacattccattggtgtctgatcactgtggggacgcctgccttgatcattcacccacactcccctggtggcaagccgattgcagggacagctgctttggttgctcacccacattgcagcctaggactcagtcagggacgcctactgaaagcctggtagctgcccacctccccttctctgtctttacctttctcttcaaatttacctccttcactatgggcaaccttccacccaccattcctccctcttcccccttagcctgtgttcttaaaaattcaaaacctcttcaactaacacctgacctaaaacccaaacatctttttttcttctgcaatactgcttggccccagtacaaactcaacagtggtttcaaatggccagaaaatggcacttttgatttctccatcctgtaagacctagataatttttgttgaaaattgggtaaatggtctgagatgtcttacgtccaagcgttttttacactttgttccctccttagcctctgaccccaatgcgactcaccctaaatctttcttctttctctcctgtccatttcttcagtctctaccccaacctcagagtcctctgaatccttcttttcttcagacccctctgacctttctccccctcccaaggccactcctcaacatgctgaatcaagttccaattcttcctcaacctctgctcccccaccttataattcttctatcatctcccctcctcacactcggttcagcttacagtttcattccatgactagctctcgcccacctgcccaacaatttcctcttagagaggtggctggagc

SEQ ID NO: 188 - DNA, 390 bp, Homo sapiens
gtccggcctctgagcccaagctaagccatcatatcccctatgacctgcacgtatacatccagatgccctgaagcaactgaagaatcacaaaagacgtgaaaatggctggtttctgccttaactgatgacattaccttgtgaaattccttctcctggctcagaagctcccctactgagcaccttgcaacccccgcccctgcccgccagagaacaaccccctttgactgtaattttccactacctacccaaatcctataaaagggccccacccctatctcccttcgctgactctcttttcggactcagcccacctgcacccaggtgaaataaacagccttgttgctcacacaaagcctgtttggtggtctcttcacacagacgcgaacaaaa

SEQ ID NO: 189 - DNA, 810 bp, Homo sapiens
gtggggaaaagcaagagagatcagattgttactgtgtctgtgtagaaagaagtagacatgggagactccattttgttctgtactaagaaaaattcttctgccttgagattctgttaatctataaccttacccccaaccccgtgctctctgaaacatgtgctgtgtcaactcagagttaaatggattaagggcggtgcaagatgtgctttgttaaacagatgcttgaaggcagcacgctccttaagagtcatcaccactccctaatctcaagtacccagggacacaaaagctgcggaaggtcgcagggacctctgcctaggaaagccaggtattgtccaaggtttctccccatgtgatagtctgaaatatggcctcgtgggaagggaaagacctgaccgtcccccagcccgacacccgtaaagggtctgtgctgaagaggattagtataagaggaaggcatgcctcttgcagttgagacaagaggaaggcatctgtctcctgcccgtccctgggcaatggaatgtctcggtataaaacccgattgtatgttccatctactgagatagggaaaaaccgccttagggctggaggtgggacatgcgggcagcaatactgctttgtaaagcattgagatgtttatgtgtatgcatatctaaaagcacagcacttaatcctttaccttgtctatgatgcaaagacctttgttcacgtgtttgtctgctgaccctctccccacaattgtcttgtgaccctgacacatccaccttacgagaaacacccacaggtgtggaggggcaacccacccctaca

SEQ ID NO: 190 - DNA, 973 bp, Homo sapiens
gtggggaaaagaaagagagatcagactgttactgtgtctatgtagaaagaagtagacataagagactccattttgttctgtactaagaaaaattcttctgccttgagatgctgttaatctgtaaccctacccccaaccccgtgctcgcagagacatatgctgtcttgactcaaggtcaaatggatttagggctatgcaggatgtgctttgttaaacaaatgcttgaaggcagcttgcttgttaaaagtcatcaccactccctactctcaagtacccagggacacaaaacactgcagaaggcctcagggacctctgtctaggaatgccatgtattttccaaggtttctccccatgtgatagtctgaaatatggccttgtgggaagggaaacacctgaccgtcccccagcccgacaccggtagagggtctgtgctgaggaggattagtaaaagaggaaggcctctttgcagttgagataagaggaaggcatctgtctccagctcgtccctgggcaatggaatgtgtcttggtgtaaaacccgattgtatattccatctactgagataggagaaaaaccgccttagggctggaggtgagacatgctggaggcaatactgctctttaaggcattgagatgtttatgtatatgcacatgaaaagcacagcacttttttctttaccttgtttatgatgcagagacatttgttcacatgttttcctgttgaccctctctccactattaccctattgtcctgccacatccccctctctgagatggtagagataatgatcaataaacactgagggaactcagagactggtgccagcatgggtcctccgtatgctgagcaccggtcccctgggcccacttttctttctctatactttgtctctgtgtctctttcttttctcaagtctctcgtttcacctgatgagaaacacccacaggtatggaggggcaggccaccccttca

SEQ ID NO: 191 - DNA, 8209 bp, Homo sapiens
gtcaggcctctgagcccaagccaagccatcgcatcccctgtgacctgcacatatacgcccagatggcctgaagtaactgaagaatcacaaaagaagtgaatatgccctgccccaccttaactgatgacattccaccacaaaagaagtgtaaatggccggtccttgccttaactgatgacattaccttgtgaaagtccttttcctggctcatcctggctcaaaaagcacccccactgagcaccttgcagcccccactcctgcccgccagagaacaaaccccctttgactgtaattttcctttacctacccaaatcctataaaacggccccacccttatctcccttggctgactctcttttccaactcagcccacctgcacccaggtgaaataaacagtcatgtcgctaacacaaagcctgtttggtggtctcttcacatggacgcgcgtgaaatttggtgccgtgactcggatcgggggacctcccttgggagatcaatcccctgtcctcttgttctttgctccgtgagaaagatccacctacgacctcaggtcctcagaccaaccagcccaagaaacatctcaccaatttcaaatccggtaagcggcctctttttactctcttctccaacctccctcactatccctcaacctctttctcctttcaatcttggcgccacacttcaatctcccccttctcttaatttcaattcctttcattttctggtagagacaaaggagacacgttttatcggtggacccaaaactctacagggcaagaacccccaatcccttatttctgcaccccaacctcttatctctgtgccccaatcccttatttccacgccccaatcccttatttccgtgccccaacctcttatatctctgcgccccaatcccttatttccgcaccccgacctcttatctctgcgccccaatcccttatttccgtgccccgaccccttatttccgtgccccgaccccttatttccgtgccccgaccccttatttccatgccccgaccccttatttccttgccccgaccccttatttctgcaccccatcccttatttccgtgccccgacctctaatctctgtgccccaaccccttttcccacttttctggaaggtaagaacctccgaaccccttccctccttttctctactctctcttttctctaggcttccttcactatgggcaaccttccaccctccattcctccttctactcctttgtcctgtgttctcaaaaacttaaaacctcttcaactcacacctgacctaaaacctaaatgccttattttcttctgcaatgccgcttgaccccaatataaatttgacagtagttccaaatagccagaaaatggcactttgaatttttccatcctgcaagatctaaataattcttgtcgtagaataggcaaatggtctgaggtgcctgacgtctaggcattcttttacacatcagtcccttcctagtctctgtgcccagtgcaactcgtcctaaatcttccttctttccctcccgcctctcccctcagtaccaaccccaagcatcgctgagtctttctaatcttccttttctacagacccatctgacctttcccttcctccccaggctgctcctcaccaggccgagctaggtcccaattcttcctcagcctctgctcctccaccctgtaatctttttatcaccccccctcctcacacctggtctggcttaccgtttcattccctgactagccctccccctcctgcccagcaatttactcttaaaaaggtggctggagctaaaggcatagtcaaggttaatgctctttttctttatcccaaatcagatagcatttaggctctttttcatcaaatataaaaatccagcccagttcatgatttgtttggcagcaaccatgagacactttacagccctagaccctaaaaggtcaaaaggccgtcttattctcaaaatacattttattacccaatctgctcccgacattaaataaaactccaaaaattaaattccggccctcaaaccccacaacaggatttaattaacctcgccttcaaggtgtacaataatagaaaaaagttgcaattctttgcctccactgtgagacaaaccccagccacatctccagcacacaagaacttccaaatgcctgaactgcagcagccaggcattcctccagaacctcctcccccaggagcttgctacaagtgccagaaatctggccaccaggccaaggaatgcctgcagcccaggattcctcctaagccgtgtcccaactgtgtgggaccccgctggaaatcggactgttcaactcacctggcagccactcccagagcccctggaactctggcccaaggctctctgactgactcctcggcttagcggctgaagactgacgctgcttgatcacctcggaagcccccgtagaccatcacggacgccgagctttaggtaactctcacagtggaaagtaagtccatccccttcttaatcaatacggaggctaccccctccacattaccttcttttcaagggcctgtttcccttgcctccataactgttgtgggtattgacggccaggcttctaaacctcttaaaactccccaactctggagccaacttagacaatactcttttaagcactcttttttagttatccccacctgcccagttcccttattaggctgagacactttaactaaattatctgcttccctgactattcctggactaccgctatatctcattgccgcccttcttcccaatccaaagcctcctttgcgtcctcctcttgtatccccccaccttaacccacaagtataagatacctctactccctccttggcgactgatcatgcaccccttaccatctcattaaaacctaatcacccttaccccactcaatgccaatatcccatcccgcagcccgctttaaaaagattaaagcctgttatcactcgtctgctacagcatggccttttaaagcctataaactctccttacaattcccccattttacctgtcctaaaaccagacaagccttacaagttagttcaggatctgcgccttatcaatcaaattgttttgcctatccaccccgtggtgccaaacccatatactctcctatcctcaatacctccctccacaatccattattctgttctggatctcaaacgtgctttctttactattcctttgcacccgtcatcccagcctctcttggctttcacttggactgaccctgacacccattaggctcagcaaattacctgggctgtactgccgcaaggcttcacagacagcccccattacttcagtcaagcccaaatttcatcctcatctgttacctatctcggcataattctcgtaaaaacacacgtgctctccctgctgatcgtgtccgactaatctcccaaacctcaatcccttacaaaagaacaactccttgccttcctaggcatggttagtacggtcagaattcttacacaagagccaggaccgcaccctgtagcctttctgtccaaacaacttgaccttactgttttagcctagccctcgtgtctccgtgcagtggctgccgctgctttaatacttttagaggccctcaaaatcacaaactatgctcatctcactctctatagctctcataatttccaaaatctattttcttcctcacacctgacacatatactttctgctccccggctccttcagctgtactcactctttgttgagtctcccacaattaccattgttcctggcccggacttcaatccggcctcccacattattctggataccacacctgaccgtcatgactgcatctctctgatccacctgatgttcaccccatttccctacatttccttcttccctgtttctcacactgatcacacttggtttattgatggcagttccaccaggcctaatcgctactcaccagcaaaggcaggctatgctatagtatcttccacatctatcattgaggctaccgctctgcctccctccactacctctcagcaagccgaactagttgccttaactcaagccttcactattgcaaaaggactacacatcaatatctatactgattctaaatatgcctttcatattctgcaccaccatgcagtcatatgggctgaaagaagtttcctcactacacaagggtcctccatcattaatgcctctttaataaaaactctgctcaaggctgctttacttccaaaagaagctggggtcattcactgcaaggggcatcaaaaggcatcagattccattgctctagccaatgcttatgctgacaaggtggctagacaagcagctagctctccaacttctgtccctcatggccagtttttctccttcacttcagtcactcccacctattcccccactgaaacttccacctatcaatctcttcccacacaaggcaaatggttcttagaccaaggaaaataccttcttccagcctcacaggcccattctattctgtcgtcatttcataacctcttccatgtaggttacaagccgctagcccgactgttagaacctctcatttcctttccatcatggaaatctatcctcaaggagatcacttctcagtgttccatctgctattctactattatccctcagggattgttcgggcctcctccctttcctacacatcaagctcggggatttgcccctgccgaggattggcaaattgactttactcacatgcctcgagttagaaaactaaaatatctcttagtctgggtagacactttcactggatgggtagaggccttccccacagggtctgagaaggtcactgcggtcatttcttcccttctgtcagacataattcctcggtttggctttcccacctctatacagtctgataacggaccagcctttactagccaaatcacccaagcaatttctcaggatcttggtattcagtggaaccttcatatcccttaccatcctcaatcttcaggaaaggtagaacagactaatggtcttttaaaggcacacctcaccaatctcagcctccaacttaaaaaggattggacagtacttttacctcttgctcttctcagaatcagagcctgtcctcgagatgctacagggtacagtccatttgaacttttgtatggacgcactttcttgcttggccccaaccccatcacagacaccagccctctaggcgactatcttccagtcctccagcaggctagacaggaaatttgccaggctgctaatcttctcttgcctactccagatccccagccatatgaagacaacctagctggacgatcagttcttgttaagaatctgacccctcaaactctacaacctcgatggaccggaccctacttagtcatctatagtaccccgactgccgtccgcctgcaggatcctccccactgggttcactgttccagaataaagctgtgtccatcggacagccagcctaatcccttcctcttcctcctggaagtcgcaagtactctcccccacttcccttaaactcactcgtatttctgaagaacagtaataacccttatgagcctaatatatcccttcattctattcgatctgttcgtccttaccctactttttgcaacagggctttacgaagtcacccccaccacttaggccgagccccaaaaaactagtcatccctactatcttctgtcagatcatactcctattctccattctcaaccacttataaatggcctactcttgtttacaccgccggtttacactgcttcttcaagccatcacagctgatatctcttggtgctatccccaaactgccactcttaactccctcttagagtggatagatgatctttgctggcaaggcaccctccaatacttccaccctgatgaagttctattctttacttttatactcactcttattctcattcccattcttatgtcaccctctacctctccccagctatctccaccacactgtcaaccttacccatcctctcctagctgcttctaatccctccttagcgaacaactgctggctttgcatttccctttcttccagtgcctacacagctgtctccgccttacagacagactgggcagtatctcctgtctccctacacctccgaacttcctttaacagccctcacctttaccctcctgaagaattcatttactttctagacaggtccagcaagacttccccagacatttcacatcagcaagctgccgccctccttcgcacttatttaaaaaacctttctccttatattaactctacttcccccatatttggacctctcactacacaaactactattccagttgccgctcctttatgtatctctcggcaaagacccactggaattcccctaggtaatctttcaccttctcgatgttcctttacttttcatctctgaagtccaactacacacatcactgaaacaattggagacttccagctccatattacagagaagccctctatcaatactgacaaacttaaaaacattagcagtaattattgcttaggaagacacttgccctgtatttcactccatccttggctaccttccccttgctcatcagactcttctcccaggccctcttcttgtttacttatacccagccccgaaaataacagtgaaaggttgttcatagatactcaacgttttctcatacaccatgaaaatcgaacctccccctctatgcagttaccccatcagtccccattacaacctctgacagctgccgccctagctggattcctaggagtctgggtacaagacacccctttcagcactccttctcatctttttactttacatctccagttttgcctcacacaaggtctcttcttcctctgtggatcctctacctacatgtgtctacctgctaattggacaggcacatgtacactagtcttccttacccccaaaattcaatttgcaaatgggaccgaagagctccctgttcccctcatgacaccgacacgacaaaaaagagttattccactaattcccttgatggtcggtttaggactttctgcctccactattgctctcggtactggaatagcaggcatttcaacctctgtcacgaccttccgtagcctgtctcatgacttctctgctagcatcacacacatatcacaaactttatcagtcctccaggcccaagttgactctttagctgcagttgtcctccagaaccgccaaggccttgacttactcactgctgaaaaaggaggactgcatattcataaatgaggagtgttgtttttacctaaatcaatctggcctggtgtatgacaacataaaaaaactcaaggatagagccccaaaacttgccaaccaagcaagtaattacgctgaacccccttgggcactctctaattggatgtcctgggtcctcccaattcttagtcctttaatacccatttttctccttcttttattcagaccttgtatcttccatttagtttctcaattcatccaaaaccgtatccaggccatcaccaatcattctatacgacaaatgtttcttctaacatccccacaatatcaccccttaccacaagacctcccttcagcttaatctctcccactctaggttcccacgccgcccctaatcccgcttgaagcagccctgataaacatcacccattctctcgccatatcaccccccaaaaattttcactgccccaacacttcaacactattttgttttatttttcttattaatataagaaggcaggagtgtcaggcctctgagcccaagccaagccatgcatcccctgtgacctgcacgtatatgcccagatggcctgaagtaactgaagaatcacaaaagaagtgaatatgccctgcaccaccttaatgatgacattccaccacaaaagaagtgtaaatggccggtccttgccttaactgatgacattaccttgtgaaactccttttcctggctcatcctggctcaaagcacccccactgagcaccttgcggcccccactcctgcccgccagagaacaaaccccctttgactgtaattttcctttacctacccaaatcctataaaacagccccacccttatctcccttggctgactctcttttcggactcagcccgcctgcacccaggtgaaataaacagccatgctgctcacacaaagcctgtttggtggtctcttcacacggatgcgcatgaaa

SEQ ID NO: 192 - DNA, 842 bp, Homo sapiens
atactgaacccccttgggcactctctaattggctgtcctgggtcctcccaattctttgtcatttaatatttgtttttctccttctcttcattcagaccttgtgtcttccatttagtttctcaattcatagaaaaccacatctaggccatcagcaatcactctacatgacaaatgctccttttagcaaccccacaatatcaccctttaccacaaaatcttccatcagcttaatctctcccactctaagatcccacatcgccccaatcccactcaaagcagccctgagagacactgcccattatctctccatacaactcccagaaattttcactgccccaacactttaccactatttcattttatttttcttattaatataagaagacaggaatgtcaggcctctgagccatgctaagccatcatataccctgtgacctacacatatacatccagatggcctgaagtaactgaagaatcacaaaagaagtgaaaatttcctgttcctgccttaactgatgacattccaccacaaaagaagtgaaaatggcctgttcctgccttgactgatgacattaccttgtgaaattacttctcctggctcatcctggctcaaaagcacccccactgagcaccttgtgaaccccacccctgcctgtcagagaacaaccccctttgactgtaattttccattacctacccaaatactatgaaacggccccatccctatctcccttcactgactgtctttctggactcagcccacctgcacccaggtgaaatacacagccttgttgctcacacaaagcctagttggtggtttctttacatggacaccagtgaaa

SEQ ID NO: 193 - DNA, 6120 bp, Homo sapiens
gtcaggcctctgagcccaagccaagccatcgcatcccctgtgacttgcacgtattcgcccagatggcctgaagtaactgaagaatcacaaaagaagtgaatatgccctgccccaccttaactgatgacattccaccacaaaagaagtgtaaatggccggtccttgccttaagtgatgacattaccttgtgaaagtccttttcctggctcatcctggctcaaaaagcacccccactgagcaccttgcgacccccactccggcccaccagagaacaaaccccctttgactgtaattttcctttacctacacaaatcctataaaatgaccccatccttatctcctttcgctgactgtcttttcagactcagcccacctacacccaggtgaaataaacagccatgttgctcacacaaagcctgtttggtggtctcttcacacggatgcacatgaaatttggtgccatgactcagatcgggggacctcccttaggagatcaatcccctggcctcctgttctttgctccatgagaaagatccacctacgacctcaggtcctcagactgaccagcccaagaaacatctcaccaatttcaaatccagtaagcggcctctttttactctcttctccaacctccctcactatccctcaacctctttctcctttcaatcttggcaccactcttcaatctctccgttctcttaatttcaattcctttcattttctaggagagacaaaggagacacgttttatccgtggacccaaaactccggcgccggtcacggactgggaaggcagccttcccttggtgtttaatcattgcagggacacctctctgattattcacccatgtttcaaaggtgtcagaccatggagggatgcctgccttggtccttcacccttagcggcaagtccagcttttctaggaaaggggcaagtaccccaaccccttctttccttgtctctaccccttctctgcttttctgggggaggggcaagtacccctcaaccccttctccttcacccttagcggcaagtcccgcttttctgggggaggggcaagtacccctcaaccccttctccttcactcttagtggcaagtcccgctcttctagagcaggggcaagtaccccaacctcatatctctgtgccccagtcccttatttccacgccccaacctcttatatctctgcaccccaatcccttatttccatgccccaacctcttatctctgtgccccaatcccttatttccatgccccgaccccttatttctgtgccccatcccttatttctgtgccccaacctcttatctctgtgccccaaccccttttcccacttttctggaaggtaagaacccccgaaccccttccctccgtttctctactctcttttctctaggcttgcttccttcactatgggcaactttccaccctccattcctccttctactcccttggcctgtgttctcaaaaacttaaaacctcttcaactcacacctgacctaaaacctaaatgccttattttcttctgcaatgctgcttgactccaatacaaactcgagagtagttccacatagccagaaaatggcactttgaatttttccatcctgcaaaatctaaataattattgtcgtaaaataggcaaacggtctgaggtgcctgaagtccaggcattcttttacacatcagtcccttcctagtctctgtgcccagtgcaactcatcccaaatgttccttctttccctcccatctgtcccctcagtaccaaccccaagcgtcactgagtctttctaatcttccttttgtacagacccatctgacctctcccttcctccccaggctgctcctcgccaggccgagctaggtcccaattcttcctcagcctccgttcctccacgctgtaatctttttatcacctcccctcctcacacctggtccggcttacagtttcgttctgtgactagccctcccccacctgcccagcaatttactcttaaaaaggcggctggagccaaaggcatagtcagggttaatgctcctctttctttatcccaaatcagaagcgtttaggctctttttcatcaaatataaaaatccagcccagttcatggctcgtttggcagcaaccctgagccactttacagccctagaccctaaaaggtcaaaaggccgtcttattctcaaaatacattttattacccaatctgctcctgacattaaataaaactccaaaaattaaattctggccctcaaaccccacaacaggatttaattaacctcgccttcaaggtgtacaataatagaaaaaatttgcaattccttgccttcactgtgagacaaaccccagccacatctccagcacacaagaacttccaaacgcctgaaacgcagtggccaggcattcctccagaacctcctcccacagagcttgctacacgtgctggaaatctggacactgggccaaggaatgcccacagcctgggattcctcctaagccgtgtcccatctgtgcgggaccccactggaaatcggactgttcaactcacctggcagccactcccagagcccctggaactctggcccaaggctctctgactgactccttcccagatcttctcagcttagcagctgaagactgacactgcctaatctcctcggaagccccctagaccatcatggacgccgagcttcaggtaactctcacagtggaaggtaagcccatccccttcttaatcaatatggagggtacccactccacattacctccttttcaaaggcctgtttcccctgcctccgtaactgttgtgggtattgatggctaggcttctaaacctcttaaaactccccaactctggtgccaacttagacaatactcttttaagcactcctttttagttacccccacctgcccagttcccttattaggctgagacactttaactaaattatctgcttccctgactattcctggactacagctatatctcattgccacccttcttcccaatccaaagcctcctttgtgtcctcctcttgtatcccccgaccttaacccacaagtataagatacctctactccctccttggtgaccaatcatgcaccccttaccatttcattaaaacctaatcacccttaccccactcaacgccaatatcccatcccgcagcacgctttaaaaagattaaagcctgttatcactcacctgctacagcatggccttttaaagcctataaactctccttacaattcccccattttacctgtcctaaaaccagacaagccttacaagttagttcaggatctgcgccttatcaaccaaattgttttgcctatccaccccgtggtgccaaacccatatactctcctatcctcaatacctgcctctacaacccattattctgttctagatctcaaacatgctttcttcactattcctttgcacccttaatcacagcctctcttcgctttcacttggactgaccctgacacccatcaagctcagcaaattacctaggctgtactgccacaaagcttcacagacagcccccattacttcaatcaagcccaaatttcttcctcatctgttacctatctcagcataattctcataaaagcacacatgctctccctgccaatcgtgtctgactgatctctcaaaccccaaccccttctacaaaacaactcctttcattcctgggcatggttggatactttcgcctttggatacctggttttgccatcctaacaaaaccattatataaactcacaaaagaaaacctagctgatcccatagatcctaaatccttttcccactcctctttctgttccttgaagacagctttagaaactgcccccactctagctctccctgactcatcccaacccttttcattacacacagccgaagtgcagggctgtgcagtcagaattcttacataaggaccaggatcgcatcctgtagcctttttgtccaaacaacttgaccttacagttttaggctggccatcatgtctccgtgcagctgctgctgcttccctaatacttttggaggccctcaaaatcacaaactatgctcaactcactctctacagttctcaacttccaaaatctattttcttcctcatacctgatgcatatactttctgctccctggctccttcagctgtactcactctttgttgagtctcccacaattaccgttgttcctggcccagacttcaatctggcctcccacattattcctgataccacacccgacccccatgactgcatctctctgatccacctgacattcaccccatttccccaaatttccttctttcctgttcctcaccctgatcacacttgatttattgatggtggttccaccaggcctaatcgccacacgccagcaaaggtaggctatgctatagtacaagccactagcctgcctcttagaacctctcatttcctttccattgtggaaatctatcctcaaggtaataacttctcagtgttccatctgctgttctactactcctcagggattattcaggccccctcccttccctacacatcaagctcgaggatttgccccacccaggactggcaaattagctttattcaacatgccctgagtcagataactaaaatacctcttagtctaggtagatactttcactggataggtagaggcctctcctacagggtctgagaaggccaccgcagtcatttcttcccttctgtcagacataattcctcagtttagccttcccacctcaatacagtctgataacagatgagcctttattagtcaaatcagccaagcagtttttcaggctcttagtgttcagtgaaacctttatgtcccttacggtcctccgtcttcaagaaaggtagaatgaactaaaggtcttttaagaacacacctcaccaagctcagccaccaacttaaaaaggactggacaatacttttatcactttcccttctcagaattcaggcctgtcctcggaatgctacagggtacaacccatttaagctcctgtatagacgctcctttttattaggccccagtctcattccagacaccagaccaacttagactgtgccccaaaaaacctgtcatccctactatcttctgtctagtcatactcctatttaccattctcaactactcatacaggccctgctcctgtttacactgctggtttacactgtttttccaagccatcacagctgatatctcctggtgctatccccagactgccactcttaactcttgaagtaaataaataatcttttctggcaggactatgctgaatctccttaagcactctctaatcagatatcctgagtagtcccaattcttagaccttttatacctgtttttctccttctgttattccatttagtttctcaattcatccaaaaccgtatccaggccatcaccaatcattctatacgacaaatgtttcttctaacatccccacaatatcaccccttaccacaagacctcccttcagcttaatctctcccactctaggctcccacgccgcccctaatcccgcttgaagcagccctgagaaacatcgcccattctctctccataccatcccccaaaaatttttgccacaccaacacttcaacactatttcattttatttttcttattaatataagaagtcaggaatgtcaggcctctgagcccaagccaagccatcgcatcccctgtgacttgcacgtatatacccagatggcctgaagtaactgaagaatcacaaaagaagtgaatatgccctgccccaccttaactgatgacattccaccacaaaaaaagtataaatggtcggtccttgccttaagtgatggcattaccttgtgaaagtccttttcctggctcatcctggctcaaaaacacccccactgagcaccttgcgacccccactcctgcccgccagagaacaaaccccctttgactgtgattttcctttacctactcaaatcctataaaagggccccacccttatctcccttcgctgactctcttttcagactcagcccgcctgcacccaggtgaaataaacagacatgttgctcacacaaagcctgtttggtgggcttttcacacggacgcgcatgaaa

SEQ ID NO: 194 - DNA, 739 bp, Homo sapiens
gtcaggcctctgagcccaagctaagccatcatatcccctgtgacctgcaggatatgctccagatggcctgaagcaactgaagatccacaaaagaagtgaaaatagccttaactgatgacattcctacactgtgatttgttcctgccccaccctaactgatcaatgtactttgtaatctcccccacccttaagaaggttctttgtaattctccccacccttgagaatgtactttgtgagatccaccccctgcccacaaaacattgctcctaaccccaccacctatcccaaaacctataagaactaatgataatcaggggggcacgatggctcaggcctgtaatcccagcactttgggaggccgaggcagccagatcacgagttcagaagatcgagaccatcctggctaacacagtgaaaccccgtctctagtaaaaatacaaaaatttagctgggcgtggtggcgggtgcctgtagtcccagctactcgggagggtgagacaggagaatggcgtgaacccgggaggcggagcttgcagtgagctgagactgcgccagtgcactccagcctgggtgacagagcgagactccatctccaaaaaagaaaaagaaccaatgataatcccaccaccctttgctgactctcctttcggactcagcccgtctgcacccaggtgaaataaacagccttgttactcacacaaagcctgtttggtggtgtcttcacccggacgcatgtga

SEQ ID NO: 195 - DNA, 6222 bp, Homo sapiens
actgaagaaccacaaaataagtgaaaatggctggttcctgccttaaccgatgacattccaccattgtgatttgttcctgccccatcctaactgatcaattgatcttgtgaaattctttctctggacaatgaatctcggaagctccccattcagcaccttgtaacccctgcctctgtctgcaagagaaaaaccccctttgactgtaattttccactaccctcccaaatcctataaaactgccccacccctatctacctttttcggactcagtctgcctgcacttgggtgattaaaaagctttattgctcacacaaagcctgtttgttgggctcttcacacggacacacgtgacatttggtgctgaagatctgggacagggggattccttcaggagaccagtcccctgtcctcaccctcactccatgagaagatccacctatgaccttgggtcctcaggccagcccaaggaacatcttaccaatttcaaatcgggcaagcggtcttttcactctcttctccagcttctctcgctacctttcaatctccctgtccttccaattccagttctttttcctctctaatagagacaaaggagacacattttatctgtggacacaaaactccagcgtgggtcacggacttgggaagacagtcttcccttggtgtttaatcaccgtgtggatgcctgccctgatcattcacccacattccactggtgtctgatcactgtggggatgcctgcctgattattcacccacattccactagtgtctgatcactgtggggatgcctgcctgattattcacccacattccactagtgtctgatcactgtggggatgcctgcctgattattcacccacattccactagtgtctgatcactgtggggacgcctgccttggtcattcacccacattcccttggtggcaaatcaattgtggagacgcctgctttggctgctcacccacattacagcccagggctgctcaccacccccttctctgtgtctctacctttctctttaaacttacctccttcactatgggcaagcttccaccctccattcccccttcttctcccttagcctgtgttctcaagaacttaaaacctcttcatctcacgcctgacctaaaaccttactgccttattttcttctgcaacactgcttggccccaatacaaactcaacaatggttctaaatggccagaaaacagcacttttgatttctccatcttacaagacctggatgatttttcttgaaaaatgtgcaaatggtctgagatgcctgacatccaggcattcttttacacatcagtccctccctagtctctgctcccagtgcgactcatcacaaatcttctttctctcctgtctgttccttcagtctccaccccaagctctgagtcctttgaatcctccttttctatggacccatctgacctctcccctcctcaccaggctgctcctcaccaggctgagccaggtcctaattcttcctcagcctccactccccagccctataatccttctatcacctccccctcctcccaccctgtctggcttatagttttgttccacgactagccctccccaacctgcccaacgatttcctcttacagaggtggctgcagctcaaggcagagtcaaggttaaccctcctttttctttatctgacctctctcaaatcagttagtgttcaggctctttttcgtcaagtataaaagcccagcccagttcatggcctgtttggcaacaacccttagatgctttgccgccctagacccagaggggccagaaggccgtcctattctcaatatgcattttactactcaacccactcccaacattagaaaaagctccaaaaattagattctggccctcaaaccccacaacaagacttaatcaatctcgccttcaaggtgtacaataatagagaagagtcagccaagcggcaacttatttctgagttgcaattacttgcctccactgtgagagaaaccccagccacatctccagcacacaagaacttcaaaatacctaaaccacagtggccaggcattcctccaggaccttctcccccaggatcttgcttcaagtgctggaaatctggccactgggccaaggaatgaccacagcctgggattcctcctaagccatgtcccacttgtgcaggaacccactggaaataggactgtccaacttgcctggaagccactcccagagcccctggaactctggcccaaggctctctgactgactccttcccagatcttctcagcttagcggctgaagactgacacagcccaatcacctcggaagcctcctggaccatcacagatgctttaggtaactcttagagtggagtgtaagtccatacccttcttaatcaatacggaggctacccactccacattaccttcttttcaagggcctgtttaccttgcccccataactgttgtggatattgatggccaggctgctgggccctttaaaactcccccactctggtgtcaacttggaaaacagtcttttatgcctcttttttagttatccccatctgcccagttcccttattagatcaagacattttaagtgaattatctgcttctctgactattcctgggctacagccacatctcattgctaccctttcccctgttcaaaacctccttcatgtcttcctcttgtatcccctgcacctgaacccacaagtatgagacaactctactccctccctagcaattgaccacatgcccattactatcccattaaaatctaatcatccttaccctgctcaacaccagtatcccatcccacaacaggctttgagaggactaaagcctgtccaggatcttcaccttatcaaaaaaattgtcttgcctatccaccccgtggtgccaaacccatatactctcctatcctcaatacctccctccacaaccccttattctgttctggatttcaaagatgctttctttgctattcctttacacccttcatcccagcctctcttcgctttcatttggactgaccctgatacccatcagtctcagcaacttacctgggctgtactgctgcaaggcttcagggacagcgcccattacttcagtcaagccctttctcatactttactttctttctgtccatctgcttctcaccgtattcaatattttgacaaccttctactttatagcccctcctacagatcttcccaacaggacatcctcctgctcctccaacatctattctcaaaaggataatgcaactcccccgtcaaaggccaaatttcttcctcatccattacctatctcagcataactcttcataaaagcacatatgctctccctgttgatcgtgtccggctaatctcccaaaccccaaccccttctacaaagcaacaactcctttccttcctaggcatagttaggtactttcgcctttggatatctgtttttgccatcctgactaaaccatcatacaaaaggaaacctagctgaccccatagatcctaaatcctttccccactcgtctttccgttccttaaaaactgtcctaaaagctgctcacacactagctctccctaactcatcccaacccttttcattacacgcagccaaagtacaggactgtgcagtcagaattcttacacaagagccgggactgcactctgtagcctttctatccgaacaacctgaccgcacagttctgagctggccttcatgtctgtatgcagtgacagccaccgctttaatacttttagaggccatcaaaatcacaagctatgctccatttactctacagttcccataactttcaaaatccattttcctcctcacacttgatgcgtatactttctgctccctagctccttcaactgtactcactatttgttgaatctcccacaattaccattgttcctggcctggacttcaatctggcctcccacattattcctgctaccacacctgacccccatgattgtatctctctgatccacctggcattcactccatttccccatatttccttctttcctgttcctcaccctgatcacacttggtttattgatggcagttccaccaggcctaattgccactcaccagcaaaggcaggctatgctatagtatcttccacatctatcattcaggctactgctccgccctcctccactacctctcagcaagccaaactcattgccttaactcaggccctcactcttgcaaagggactacacgtcaatatttatactgaccctaaatatgccttccatatcctgcaccaccatgctgttacatgggctgaaagagttttcctcaccatgcaagggtcctccatcgttaatgactctttaataaaaactcttctcaaggctgctttacttccaaaggaagctggagtccttcactgcaaaggccatcaaaaagcctcagaccccattgctcaaggcaacaattatgctgataagacagctaaagaagcagccagtattcctacttatgtccctcatggccagtttttctccttctcatcagtcactcctactcactctcccactgaagtttccacctatcaatccctccctactcaaggcaaatagttctttgaccaaggaaaattcctccttccagccttacagctcattccattctatcgtttttcataacctcttccatgtaggttacaagccactagccctcctcttagaacctctcatttcctttccatcatggaaatctatcctcaaggaaatcacttctcagtgttccatttgctattctcccactcctcagggagttcgcccctgcccaggattggcagattgactttacccacatgccccgagtcaggaaactaaaatacctcttggtctgtgcagacactttcactggatgggtagaggcctttccctcagggtctgagaaggccaccgcggtcatctcctcccttctgttgacataattcctcaatttagcctcccgctctacccagttgtcccatcaatccccattacaacttctaatggctgctgccctagctggatccctagtgttagatatgagttctaaatttcttttcaaagaatcaatatgtcagtaggttcaattctttgccttctacttttaaacttaacttcctcgtaaagcaaactttttcaattacctgctccaccctgactcatttcaatcacctgctccaccctgactcattccgattacctgctccaccctgactcattctgattacctgttccaccctgactcattccaatgacctgctgtcataaccatttttcctgccaaaccactcaccctgtcactctctttaaattagccaattgaaattagtttagcctgtgcggtctaaccctagccaataggggaaggacgcagcagcaggggccacgtgcatcagggataagaaccccttcccgtcccttgtccaagtgtgtgctcaccattgctccatctgtaagggtgcaaccttctatagaagtaacttgccttgctgagaattaaaaagaaaattttatattcgagtgctatttcttttgtggcacagaaacttcatatataatactaggagtctgggtacaagacacctcttttagtgctctttctcattttttcactttgcatttccagtgttgcacaaggtctcttcttctgtgactcctctacctacatgtgtctacctgctaataggacaggcacgtgcacactagttttccttactcccaaaattcaatttgcaaataggactgaacagcttcctcttcccctcatgacaccaacacttcaccactattttgttttatttttcttattaatatagaagacaggaataggcctcgacttactgctgaaaaaggagaactctgtatatttttaaatgaagagtgttgtttttacccaaatcaatctggcctggtgtatgacaacataaaaaaactcaaggatagagtccaaaaacttgccaaccaagcaaataattacgctgaaccgccttgggcactctctaactggatgtcctggttcctcccaattcttagtcctttattacctctttttctccttctcttattcagaccttgtgtcttctgtttagtttctcaattcacacaaaaccacatccaggccatcaccaatcattctatatgacaaatgctccttctaacaaccccacgatatcaccccttaccccaaaatctttcttcagtttaa

SEQ ID NO: 196 - DNA, 5682 bp, Homo sapiens
gtcaggcctctgagcccaagcgaagccatcatatcccctgtgacctgcacatacactcccagatggccggttcctgccttaactgatgacattccaccacaaaagaagtgaaaatggcctgttcctgccttaactgatgacattgtcttgtgaaattccttctcctggctcatcccggctcaaaagctcccccactgagtaccttgtgacccccattcctgcctgccagagaacccccttttttcctttacctacccaaatcctataaaatggccccaaccttatccccttttgctgactttctttttggactcagcccacctgcacccaggtgaaataaacagctttattgctcacacagagcctgtttggtggtctcttcacatggacacacatgaaatttggtgccgtgactcagaccgggggacctcccttgggagatcaatccctgtcctcctgttctttgctccatgagaaagatccacctatgacctcaggtcctcagacccaccagcccaaggaacatctcaccaattttaaatccggtaagcggcctcttcttactctcttctccaacctctctcactatccctcaaccactttctcctttccactcttccatctctcccttctcttaatttcaattcctttcattttctgatagagacaaaggagacctgttttatccgtggacccaaaactccagcaccagtcacggactgggaaggcagccttcccttggtgtttaatcattgcagggacacctctctgattattcacccacgtttcagaggtgtcagaccatgcagggacacctgccttggtccttcacccttagtggcaagtcccgcttttctgggggaggggcaagtaccccaaccccttctctccatgtctctactccttctccacctttctggggggcaagaaacccccaaccccttctccttcacccttagtggcaagtcctgcttttctaggggaggggcaagtagcccaacctcgtatctctgtgccccgaacccttatttccacgccccaacaccttatatctctgtgccccaatcccttatttctgtgccccaacctcttatacctctgcgccccaatcccttatttccatgcccctatcttgtatctctgtgcccctacccctttcccacttttctggagggtaagaacccccgaaccccttccctccgtgtctctactctcttctctgggcttgcctccttcactatgggcaaccttccaccttccattcctccttctccctcagcctatgttcttaagaacttaaatcctcttcaactctcacctgacctaaaatccaagtgtcttattttcttctgtaatgccgcttgaccccaatacaaactcgacagtagttccaaatagccagaaaatggcactttcaatttttccatcctacaagatctaaataattcttgtcgtaaaataggcaaatggtctgaggtgcctgacagccaggcattcttttacacatcagtccctctctagtctctgttcccaatgcagcttatcccaaatcttccttctttctctcccacctgccccctcagtcccaaccccaagcgcctctgagtcttcctaatcttccttttctacagacccatctgacctctcccctcctccccaggctgctccttgccaggccaagctaggtcccaattcttcctcagcctctgctcctccaccctataatccttttatcacctctcctcctcacacctggtctggcttacagttttgttccgtgactagccctcccccacctgcccagcaatttactcttaaaaaggtggctgaagctaaaggcatagtcaagattaatgctcctttttctttatcagacctctcccaaatcagtgagcatttaggctctttcatcaaatatgaaaaacccagcccagttcatgacttgtttggcagcaaccctgagacgctttacagcctagaccctaaaaggtcaaaaggccatcttattctcaatatacactttattgcccaatctgctcccgacattaaataaaactccaaaaattaaattccggccctcaaaccccacaacaggatttaattaacctcgccttcaaggtgtacaataatagaaaacagttgcaattccttgcctccactgtgagacaaaccccagtcacatctccagcacacaagaacttccaaacgcctgaaccgcagtggccaggtgttcctccagaacctcctcccccaggagcttgctacaagtgccagaaatctggccaccaggccaaagaatgcctgcagcccaggtttcctcctaagccacatcccatctgtgcgggaccccactggaaatcagactgtccaactcacctggcagccactcccagagcccctggaactctggcccaaggctctctgactccttcccagatcttcttggcttagcggctgaagactgacgctgcccgattgccttgcaagccccctcgaccatcacggacgctgagcttcgggtaactctcacagtggagggtaagtccgtctccttcttaatcaatacagaggctactcactctacattaccttattttcaagggcctgtttctcttgcttccataactgttgtgcgtattgacggccaggcttctaaacctcttaaaactccccagctctggtgccaacttagacaatactcctttatgcactcccttttagttatccccacctgcccagttcccttattaggccgagacactttaaattatctgcttccctgactattcctggattacagctgcatctcattgctgcccttcttcccaatccaaagcctcctttgcgttctcctcttgtatccccccaccttaacccacaagtataagatacctctactccctccttggcaaccgatcatgcaccccttaccatctcattaaaacctaatcacccttacccagctcaatgccaatatcccatcccacagcatgctttgaaaggattaaagcctgttatcactcacctgctacagcattgccttttaaagcctataaactctccttatgattcccccattttacctgtcctaaaaccagacaagacttacaggttagttcaggatctatgccttatcaaccaaattgttttgcctatccaccctgtggtgccaaacccatatactctcctatcctcaatacctccctccacaacccattattctgttctggatctcaaacatgctttctttactattcctttgcacctttcatcccagcctctctttgctttcacttagactgaccctgacacccattaggctcagcaaattacctaggctgtactgcctcaaggcttcacagacagcccccattacttcagtcaagcccaaatttcatcctcatctgttacctctctcggcataagtctcataaaaacacacgtgctctccctgctgatcgtgtctgattaatctcccaaacctcaatccctttcaaaacaacaactcctttccttcctaggcatggttagtggggtcagaattcttacacaaaagccaggaccgccccctgtagcctttctgtccaaacaaattgaccttactgttttagcttagcccttatgtcttcatgcagcggctgccactgctttaatacttttagaggccctaaaaatcacgaactatgctcaactcactctctacatgtctcataacttccaaaatctattttcttcctcatacctgattcatatactttctgctcccccgctccttcagctgtactcactttttgttaactcccacaattatcattgttcctggcccagacctcaatctggcctcccacattattcctgataccacacctgacccccatgactgtatctctctgatccacctgacattcaccccatttccccatatttccttctttcctgttcctcaccctgatcatgcttgatttattgatggcagttccaccaggcctaatcgccacacaccagcaaaggcaggctatgctatagtacaagccacaagcctgcctcttaaaacctctcattttctttccatcatggaaatctatcctcaaggaaataacctctcagtgttccatctgctattctactactcctcagggattattcaggccccctcccttccctacacatcaagctcgaagatttgcccccacccaggactggcaaattagctttactcaacatgccccgagtcagataactaaaatacctcttagtctaggtagacactttcactggataagtagaggcctttcctacagggtctgagaaggccaccgcagtcatttcttcccttctgtcagacataattcctcaggttagccttcctacctctatacagtctgataacagaccagcctttattagtcaaatcagccaagcattttttcaggttcttagtattcagtgaaacctttatatcccttacagtcctcagtcttcaagaaaagtagaatggactaaaggtcttttaaaaacacacgtcaccaagctcagtcaccaacttacaaaggactggacaatacttctaccactttcccttctcagaagtcatacctgtcctcagaatgctacaaggcagagcccatttgagctccagtatagacactcctttttattaggccccagtctcattccagacaccagaccaacttagactgtgcccccaaaaaacttgtcatccctactgtcttctctctagtcatacttctattgactgttttcaactactcatacatgccctgctcttgtttacaatgccggtttacactctttctccaagccatcacagctgatatctcctagtgctatccccaaactgccactcttaactcttgaaataaataaataatctttgctgacaggactatgctgaatctccttaggcactctctaatcagatgtcctgagtcgtcccaattcttagacctttcatacctgtttttctccttctcttattccatttagtttttcaattcatacaaaactgtatccaggccatcaccaataattctaaatgacaaatgttccttctaacaaccccacaatatcaccccttaccacaaaatcttccttcagcttaatctctcccactctaggttcccacgccgcccctaatcccgctcaaagcagccctgagaaacatcgcccattatctctccataccgtccctcaaaatttttgccatcccaacactttaccactgtttcattttatttttcttattaatataagaagacaggaatgtcaggcctctgagcccaagcgaagccatcatatcccctgtgacctgcacatacacatccagatggctggttcctgccttaactgatgacattccaccacaagagaagtgaaaatggcctgtttctgctttaactgatgacattgtcttgtccttctcctggctaatcctggctcaaaagctcccccactgagtaccttgtgacccccactcctgcccgccagagaacaaccccccattttcctttacctatccaaatcctataaaacagccccacacttatctcctttcactgactctcttttcggactcggcccacctgcacccaggtgaaataaacagctttattgctcacacaaagcctatttggtggtctcttcacacagacgtgcatgaaa

SEQ ID NO: 197 - DNA, 951 bp, Homo sapiens
gtggggaaaagaaagagagatcagattgttactgtgtctgtgtagaaagaagtagacataggagactccattttgttctgtactaagaaaaattcttctgccttgagatgctgttaatctataaccttacccccaagacatgtgctgtgtcaactcagggttaaatggattaagggctgtgcaagatgtgctttgttaaacagatgcttgaaggcagcatgctcgttaacagtcatcaccactccctaatctcaagtacccagggacacaaacactgcggaaggctgcagggacctctgcctaggaaagccaggtattgtccaaggtttctccccatgtgatagtctgaaatatggcctcgtgggcagggaaagacctgaccgtcccctagcccgacacccgtaaagggtctgtgctgaggaggattagtacaagaggaaggcatgcctctttgcagttgagacaagaggaaggcatctgtctcctgcccgtccctgggcaatggaatgtctcggtataaaaccgattgtatgttccatctactgagataggggaaaaccgccttagggctggaggtgggacatgtgggcaacaatactgctctgtaaggcattgagatgtttatgtgtatgcatatctaaagcacagcacttaattctttaccttgtctatgatgcagagacctttgttcacgtgtttatctgctgaccttctctccactattatcctatgaccctgccacatccccctctctgagaaacacccaaaaatgatcaataaatactaagggaactcagaggctggcgggatcctccatatgctgaacgctggttccctgggtccccttatttttttctctatactttgtctctgtgtctttttcttttccaagtctctcgttccacctaacgagaaacacccacaggtgtggaggggcaacccaccccttca

SEQ ID NO: 198 - DNA, 55 bp, Homo sapiens
gtcagacatctgagcccaagctaagccatcataatccctgtgacgtgcacatata

SEQ ID NO: 199 - DNA, 1000 bp, Homo sapiens; identical to SEQ ID NO: 107

SEQ ID NO: 200 - DNA, 4724 bp, Homo sapiens
gtcaggcctctgagcccaggccaggccttcgcatctctgtgacttgcatgtatacatccagatggcctaaagtaactgaagatccacaaaagaagtaaaaacagccttaactgatgacattccaccattgtgatttgttcctgccccaccctaactgatcaatgtactttgtaatctcccccacccttaagaagtttctttgtaattctccccacccttgagaatgtactttgtgagatccacccctgcccaccagagaacaaccccctttgactgtaattttccattaccttcccaaatcctataaaaccgccccacccttatctccctatgctgactctcttttcggactcagcccacctgcacccaggtgaaataaacagctttattgctcacacaaagcctgtttggtggtctcttcacatggatgcacatgaaatttggtgccgtgactcggatcaggggacctcccttgggagatcaatcccctgtcctcctgctctttgctccgtgagaaagatccacctacgacctcaggtcctcagaccgaccagcccaagaaacatctcaccgatttcaaatccggtaagcggcctctttttactcccttctccaacttccctcactatccctcaacctctttctcctttcaatcttggcgatgcacttcaatctctcccttcttttaatttcaattcctttcattttctggtagagacaaaagagacacgttttatccgtggacccaaaactccggcgctggtcatggactgggaaggcagctttcccttggtgtttaatcattgcagggacacctctctgattatacagccatgtttcaagggtgtcagaccacgcagggacgcctgccttggtccttcacccttagcggcaagtcccactttcctggggcaggggcaagtacccctcagccccttccccttcacccttagcgggaagtcccactttcctggggcaggggcaagtacccctcaaccccttctccttcacccttagcggcaagtcccgcttttctagggggcaagaacccccaaaccccttccctccgtgtctctacgctctcttctctgggtttgcttccttcactatgggcaaccttccaccctccattcctccttcttctcccttagcctgtgggctcaagaacttaaaacctcttcaacttacacctgatctaaaacctaaacgccttattttcttctgcaacaccgcttggccccagtacaaactcgacagtagttccaaatagccagaaaatggcactttgaatttttccatcctacaagatctaaataattcttgtcgtaaaaggggcaaatggtctgaggtgcctgacgtccaggcattcttttacacatcagtcccttcctagtctctgtgcccagtgcaactcgtcccaaatcttccttctttccctcccgcctgtccccttagtcccaaccccaagcgtcgctgagtctttctaatcttccttttctacagacccatctgacctctcccctcctcgccaggccgagctaggtcccaattcttcctcagcctctgctcctccaccctgtaatctttttatcgcctcccctcctcacacctggtccggcttacagtttcgttctgtgactagccctccccaacccgcccagcaatttactcttaaaaaggtggctggagccaaaggcatagtcaagtttaatgctcctttttctttatcccaaatcagaagactttaggctctttttcatcaaatataaaaacccagcccagttcatggctcgttcggcagcaaccctgagacgctttacagccctagaccctaaaaggtcaaaaggccgtcttattctcaatatacattttattacccaatctgctcccgacattaaataaaactccaaaaattaaattccggccctcaaaccccacaacaggatttaattaacctcgccttcaaggtgtacaataatagaaaaaagttgcaattccttgcctccactgtgagacaaaccccagctacatctccagcacacaagaacttccaaacgcctgaaccgcagcggccaggcgttcctccagaacctcctcccctaggagcttgctacaagtgccagaaatctgaccaccaggccaaggaatgcctgcagcccaggattcctcctaagccatgtcccatttgtgcgggaccccactggaaatcggactgttcaactcacctggcagccactcccggagcccctggaactctggcccaaggctcctctgactgactccttctcggcttagcggctgaagactgatgctgcccaatcgcctcggaagcccagtagaccatcacggacgccgagctttgggtaactctcacagtggaaggtaagtccgtccccttcttaatcaatatggaagctacgactccacattaccttcttttcaggggcctgtttcccttgcctccataactgttgtgggtattgacggccaggcttcaaaacccctgaaaactccccaactctggtgccaacttggagaacactcttttatgcactcttttgtagttatccccacctgcccagttcccttattaggccgagatgttttaaccaaattatctgcttccctgactattcctggactacagctgcatctcattgccacccttctccccagcccaaagcctccttcgtgtcttcctctcatatctccccaccttaacccacaagtatgggacatctctactccttccctggcaaccgatcacatgcccattaccatcccgttaaaatctaatcacccttaccccgctcaatgccaatatcccatcccacagcatgctttaaaaggattaaagcctgttatcactcgcctgctacagcatgggcttctaaaacctataaactctccttaccattcccccattttacctgtcctaaaaccagacaaggcttacaagttagttcagaatctgcgccttatctaccaaattgttttgcctatccaccccgtggtgccaaacccatatactctcctatcttcagtacctccctctactacccattattctgttctggatctcaaacatgctttctttactattcctttgcaaccttgatcccagcctctctttgccttcacttagactgaccctgacacccattaggctcagcaaattacctgggctgtactgccgcaaggcttcacagacagcccccattacttcagtcaagcccaaatttcatcctcatctgttacctatcttggcataattctcataaaaacacacgtgctctccctgctgatcgtgtccgattaatctctcaaacctcaatcccttacaaaacaacaactcctttccttcctaggcatggttagcatggtcagaattcttacacaacagccaggaccacaccctgtagcctttctgtccaaacaatttgaccttactgttttagcctagccctcatgtctgcgtgcagcggctgccgctgctttaatacttttagaggccctaaaaatcacaaactatgctcaactcactctctacatttcttataacttccgaaatctattttctcccttatacctgatgcatacactttctgctccccggctccttcagctgtactcactctttgttaagtcccacaattaccattgttcctggcctggacttcaatctggcctcccacattattcctgataccacacctgacccccatgactgtatctctctgatccatctgacattcaccccatttccccatatttccttctttcctgttcctcaccctgatcacgcttgatttattgatggcaggcccaccaggcctaatcgccacacaccagcaaaggcagcctatgctatagcacaagccactagcccgcctcttagaacctctcatttcctttccatcatggaaatctatcctcaaggaaataacttctcagtgttccatctgctattctactactcctcagggattattcaggccccctcccttccctacacatcaagctcgctcaattcatccaaaaccgtatccaggccatcaccaattattctatactacaaatgtttcttctaacatccccacaatatcacccctcaccacaagacctcccttcagcttaatctgtccccctctaggttcccgcttgaagcagccctgagaaacatcgcccactctctctccataccacccccaaaaaattttcgccaccccaacacttcaacactattttgttttatttgtcttactaatataagaaggcaggaatgtcaggcctctgagcccaggccaggccttcgcatcccctgtgacttgcacgtatacatccagatggcctaaagtaactgaagatccgcaaaagaagtaaaaacagccttaactgatgacattccaccattgtgatttgttcctgccctaccctaactgatcaatgtactttgtaatctcccccacccttaagaagtttctttgtaattctccccatccttgagaatgtactttgtgagatccacccctgcccaccagagaacaaccccctttgactgtaattttccattaccttcccaaatcctataaaacggccccacccttatctccctatgctgactctcttttcggactcagcccacctgcacccaggtgaaataaacagctttattgctcacacaaagcctgtttggtggtctcttcacacggacacacatgaaa

SEQ ID NO: 201 - DNA, 545 bp, Homo sapiens
gtggggaaaagaaagagggatcagactgttactgtgtttgtgtagaaagaagtagacataagagactccattttgttctgtactaagaaaaattattctgccttgagatgctgttaatctgtaaccctacccccaaccctgtgctcacagaaacgtactctgttggctcaaggtttaatggatttagggctatgcaggatgtgctttgttaaacaaatgcttgaaggcagcatgcttgttaaaagtcatcaccactccctaatctcaagtacccagagacacaaaacactgtgtaaggccgcagggatctctgcctaggaaagccaggtattgtccaaggtttctccccttgtgatggtctggaatatggccccgtgggaaggaaaagacctgacgttcccccagcccgacacctgtaaagggtccgtggtgaggaggattagtaaaagaggagggcctctgcacttcagataagaggaaggcatctgtctcctgctcgtccctgggcaatggaatgtctctgtgtaaaacccgattaactgctc

SEQ ID NO: 202 - DNA, 6158 bp, Homo sapiens
gtcaggcctctgagcccaagccaagccatcacatcccctatgacttgcatgtatacacccagatggcctgaagtaactgaagaatcacaaaagaagtgaatatgtcctgccccaccttaactgatgacattccaccacaaaagaagtgtaaatggctgatccttgccttaagtgatgacattaccgtgcgaaagtccttttcctggctcatcctggctcaaaaagcacccccactgagcaccttgcaacccccactcctgcccgccagagaaaaaaccccctttgactgtaattttcctttacctacccaaatcctataaaacagccccacccttatctctctttgctgactctcttttcagactcagccagcctgcacccaggtgaaataaacagccatgttgctcacgcaaagcctgtttggtggtctcttcaaacagacgtgcatgaaatttggtgccctgactcggatcgggggacctcccttgggagatcaatcccctgtacttctgttctttgctccatgagaaagatccacctatgacctcaggtcctcagaccaaccagcccaaggaacatctcaccaattttaaatcaggtaagcggcctcttcttactctcttctccaacctctctcactgtccctcaaccactttctccctttcactcttcaatccctcccttctcttaatttcaattcctttcattttctgggagagacaaaggagacacattttatccgtggacacaaaactccagcgccggtcacagactgggaaggcagccttcccttggtgtttaatcattgcagggacgcgtctctgattatacacccacctttcaagggtgtcagaccacgcaggaatgcctgccttggtccttcacccttagcggcaagtcccacttttctggggaaggggcaagtaccccaaccccttctctccttgtctctaccccttctctgcttttttgggagaggggcaactattcctcaaccccttctcctgcacccttagcggcaagtcccgcttttctacggggcaagaacccccaatcccttatttccacgccccaacctcttatctctgtgccccaatcccttatttctgcaccccaacctcttttctctgtgccccaatcccttatttctgcaccccaacctcttatctctgtgccccaatcccttatttctgcaccccaacctcttttctctgtgccccaatcccttatttctgcaccccaacctcttatctctgtgccccaatcccttatttctgcaccccaacctcttttctctgtgccccaatcccttatttctgcaccccaacctcttatctctgtgccccaatcccttatttctgcaccccaacctcttttctctgtgccccaatcccttatttccacaccccgacctcttatctctctgccctaatcccttatttctgcaccccgacctcttatctctgtgtcccaatcccttatttctgagccccaacctcatatctctgcaccccaaccccttatttctgtgccccaaccttttatatctctgtgccccaatcccttatttctgcaccccaaccacttttcccacttttctggaagataagaacccccaaatcccttccctccgtttctctactctctcttttctctaggcttccttccttcactatgggcaaccttccgccctccattcctccttctactcccttggcctgtgttctcaaaaacttaaaacctcttcaactcacacctgacctaaaacctaaatgccttattttcttctgcaatgccgcctgaccccaatacaaactcaacagtagttccaaatagccagaaaatggcactttgaatttttccatcctgcaagatctaaataattcttgtcgtaaaataggcaaacggtctgaggtgcctgacgtccaggcattcttttacacatcagtcccttcctagtctctgtgcccagtgcaacttgtcccaaatcttccttctttccctcctgcctgtccccccagtaccaacaccaagcgtcgctgagtctttctaatcttccttttctacagacccatctgacctctcccttcctccccaggctgctcctcgccaggccgagctaggtcccaattcttcctcagcctccgctcctccaccctataatccttttatcacctcccctcctcacacctggtctggcttacagtttcgttctgtgactagccctccccctcctgcccagcaatttactcttaaaaaggtggctagagctaaaggcatagtcaaggttaatgctcctttttctttatcccaaatcagatagcatttaggctctttttcatcaaatataaaaacccagcccagttcatggctcgtttggcagcaaccctgagacgctttacagccctagaccctaaaaggtcaaaaggccgtcttattctcaatatacattttattacccaatctgctcccaacattaaataaaactccaaaaactggaatttggccctcaaaccccacaacaggacttaattaacctcaccttcaaggtgtgcaataacagaaaaaaagttgcaattccttgcctccactgtgagacaaagcccagacacatctccagcacacaagaatttccaaacgcctgaaccatagcagccaggcgttcctccagaacctcctcccccaggagcttgctacaagtgccagaaatctgatcaccaggccaaggaatgcctgcagcccaggattcctcctaagccgtgtcccatctgtgtgggaccccactggaaattggactgttcaactcacctggcagccactcccagagcccctggaactctggcccaaggctctctgactgactccttcttggcttgccggctgaagaccgacgctgcctgatcacctcagaagccccgtagaccatcacggacgccgagctttaggtaactcacagtggagtgtaagtccgtccccttcttaatcaatacggaggctacccactccacattaccttcttttcaagggcctgtttcccttgcccccataactgttgtgggtattgacagccaggcttctaaaccttttaaaactcccccactctggtgccaacttagacaacacccttttatgcactcttttttagttatctccacctgcccagttcccttattaggccgagatattttaaccaaattatctgcttccctgactattcctggactacagccacatctcattgccgcccttctccccaacccaaagcctccttcgagtcttcctctcatatccccccaccttaacccgcaagtataggatatctctactccttccctggcaactgatcacaggcccattaccatcccattaaagcctaatcacccttaccccactcaatgccaatatcccatcccacagcacgctttgaaaggattaaagcctgttaacactcgcctgctacagcatggccttttaaagcctataaactctccttaccattcccccattttaagtgtcctgaaaccagacaaggtttacaagttagttcagaatctgcgccttatcaaccaaattgttttgcctatccaccccgtggtgccaaacccatatactctcctatcctcaatacctccctctactacccattattctgttctatatctcaaacatgctttctttactattcctttgcacccttcatcccagcctctctttgctttcacttatactgaccctgacacccattaggctcagcaaattacctgggctgtactgccacaaggcttcacagacagcccccattacttcaatcaagcccaaatttcttcctcatctgttacctatctcggcataattctcataaaaacacacgtgctttccctgctgattgtgtctgattaatctcccaaacctcaatcccttacaaaacaacaactcctttccttcctaggcatggttagtgtggtcagaattcttacagaagagccaggaccgcaccctgtagcctttctgtccaaacaacttgaccttgctgttttagcctagccctcatgtctgcgtgcagcggctgccgctgctttaatacttttagaggccctaaaaatcacaaactatgctcaactcactctctacatttctcataacttccaaaatatattttcttcctcatatctgacgcatatactttctgcttcccggctccttcagctgtactcactctttgttaagtcccacaattaccattgttcctggccgggacttcaatctggcctcccacattattcctgataccacacctgacccccatgactgtatctctctgatccacctgatattcaccccatttccccatatttccttcttttcctgttcctcaccctgatcacgcttgatttattgatggcagttccaccaggcctaatcgccacataccagcaaaggcaggctatgctatagtacaagccactagcctgcctcttagaacctctcatttcctttccatcgtggaaatctaccctcaaggaaataacttctcagtgttccatctgctattctactcctcagggattattcagaccccctcccttccatacacgtcaagctcgaggatttgcccccacccaggactggcaaattagctttactcaacatgcccaagtcaggaaactaaaatacctcttagtctaaataaacactttcactgaataagtaaaggcctttcctacagggtctgagaaggccaccacagtcatttcttcccttctgtcagacataattcctcagtttagccttcccacctctatacagtctgataacagacgagcctttattactcaaatcagccaattagtttttcaggctcttagggttcagtgaaaccttcatatcccttacggtcctccatcttcaagaaaagtagaacggactaaagatcttttaaagacacacctcaataagctcagccaccaacttaaaaaggactggacaatacttttaccactttcgtttctcagaattcaggcctgtcctcagaatgctacagggtacagcccatttaagctcctgtatagatgctcctttttattaggccccagtctcattcgacaccagaccaacttagactgtgccccaaaaaaacttgtcatccctactatcttttgtctagtcatactcctattcaccattctcaactactcatacatgccctgctcttgttttcactgctggtttacactgtttttccaagccatcacagctgatatctcctggtgctatccccaaactgccactcttaactcttgaagtaaataaataatctttgctggcaggactatgctgaatctccttaggcactctctaatcagatatcctgagtcatcccaattcttaaaccttttatgcctgtttttctccttctgttattccatttagtttttcaattcgtacaaaaccgtatccaggccatcaccaatcattctatacgacaaatgtttcttctaacatccccacaatatcaccccttaccacaaggcctcccttcagcttaatctctcccactctaggttcccacgccacccctaatcccgcttgaagcagccctgagaaacatcgcccattctgtctccataccaccccccaaaaattttcgccgccccaacacttcaacactattttgttttatttttcttattaatataagaaggcaggaatgtcaggcctctgagcccaagccaagccatcacatcccctgtgacttgcatgtatacacccagatggcctgaagtaactgaagaatcacaaaagtgaatatgccctgccccaccttaactgatgacattccaccacaaaagaagtgtaaatggccggtccttgccttaagtgatgacattaccttgtgaaagtcctcttcctgcctcatcctggctcaaaaagcacccccactgagcaccttgcaacccccactcctgcccgccagagaacaaaccccctttgactgtaattttcctttacctacccaaatcctgtaaaacggccccacccttatttccctttgctgactctcttttcggactcagcctgcctgcacccaggtgaaataaacagccatgttgctcacacaaagcctgtttggtggtctcttcacacggacgtgcatgaaa

SEQ ID NO: 203 - DNA, 999 bp, Homo sapiens
tgtgcaggtgtacctagcagctccaaagagacagcgaccatcgaggacaagccatgatgacaatggtggttttgtcaaaaagaaaagggggaaatgtggggaagagaaagagagatcagactgttactgtgtctatgtagaaagaagtagacataagagactccattttgttctgtactaagaaaaattattttgcctcgagatgctgttaatctgtaaccctacccttaaccctgtgctggcagaaacacgtgctgtgacgactcaaggtttagtggatttagggctatgcaggatgtgctttgttaaacaaatgcttgaaggcagcatgcttgttaaaagtcatcaccactccctaatctcaagtacccggggacacaaaacactgtggaaggctgcagggacctctgcctaggaaagccaggtattgtccaaggtttctccccatgtggtaatctgaaatatggcctcgtgggaagggaaagacctgaccgttccccagcccgacacccgtaaagggtctgtgctgaggaggattagtaaaagaggaaggcctctttgcagttgagataagaggaaggcatctgtctcctgctcgtccctgggcaatagaatgtctgggtgtaaaacccgattgtatattccatctactggagataggagaaaaccgccttagggctggaggtgagacatgctggcggcaataggcaatagtgctctttaaagcattgagatgtttatgtatgtgcacattaaaagcacagcacctttttctttaccttgtttatgatgtagagatgtttgttcacgttttcctgctgaccctctccccactattaccctgttgtcctgccactctccattgtctccctgttgtccccctctccgatatggtagagatactaatgaataaatactgagggaactcagagaccggtgccggcgtgggtcctccatatgctgaacgccggttccctgggcccacttttctttctctat

SEQ ID NO: 204 - DNA, 482 bp, Homo sapiens
gtaggagttcggtcagggtagtgggagaaattataagaagaaattataggaaaagatgcaaaccttcttggaaggctgggaggttttgcaaaagctttgaaagataatttggctgaaggcagccaaattctcttatccagagcctgagagcaaaaggtagataacaaggaagtgtaaaggaattgatctaggtaagttaagtttacttaggcctcagaacctggcctttaatcatgtgcgtgcaggactgctctctccaggtaaatacccacaagttgtgttgactgaaagcctttgtcattaaatgtgtattaaataaatgcccacttctcagggctgcaactgctgtgactctttacagcaccttcctgggtgtctgtgagcggtcagtcccctagccgtgtgcccaggcaaaaaaaacctgtgtctgcgtacattttctcatccgtcgcttggccagagtctgcgggtcagacccagca

SEQ ID NO: 205 - DNA, 971 bp, Homo sapiens
gtggacgaaagaaagagagatcagactgttactgttgtctatgcagaaagaagaagacataagaaactccattttgttctgaactaagaaaaattcttctgcctttagatgatgttaatctgtaaccctagccccaaccctgtgctggcagaaacatgtgttgtgttgactcaaggtttaatggatttagggctacgcagggtgtgctttgttaaaaatgtgtttgcaggcagtatgcttggtaaaagtcaccgccattttccagtctcaagtacccagggacacaatgcactgcggaaggccgcagggacctctgcccaagaaagcctgggtattgtccaaggtttctccccactgagacagcctgagatatggcctcgtgggaaggtaaagacctgaccgtctcccagcctgacaccagtaaagggtctgtgctgaggaggattagtgaaagaggaaggcctctttgcagttgagataagaggacggcatctgtctcctgctcatccctgggaatggaatgtctcggtgtaaaacccgacgtacattctatttactaagatggaaaaaaccgccttatggctggaggtgagacatgctggaggcaatactgctctttactgcactgagatgtttgtgtaaagtcaaacataaatctggcctatgtgcacatcgaggcatagaacctttccttaaacttatttacgacacagagacctttgctcacatgttttcctgctgaccctctccccaccattatcctatagtcctgccacatccccctcaccgagatagtagagatagtgatcagtaaatactgagggaactcagagaccagtgccgggtcctccgtatgctaagcgccgtcccccgggcccactgttctttctctatacttcatctctgtgtcttatttctttcctcagtctctcatcccacctgacgagaaacacccacaggcgtggaggggc

SEQ ID NO: 206 - DNA, 5645 bp, Homo sapiens
gtccagcctctgagcccaagctaaaccatcatatcccctgtgacctgcacatacacatccagatgggcgattcctgccttaactgatgacattccaccacaaaagaagtgaaaatggcctgttcctgccttaactgatgacattaccttgtgaaattccttctcttggctcatcctggcttaaagctcccccgctgagcaccttgtgaccccccccccaacccctgcccgccacagaacaaaccccctttgactgtaattttcctttatctacccaaatcttataaaatggccccacccctatctcccttcgctggctctcttttcggactcagcccacctgcccccaggtgaaataaacagccttgttgctcgcacaaagcctgtttcgtggtctcttcacatggatgcgagtgaaattttggtgccgtgactcggatcgggggacctcccttgggagatcaatcccccgtcctgctctttgctccgtgagaaagatccacctacgacctctggtcctcagaccgaccaggccagggaacatctcaccaattttaaatcaggtaagcgacctctttttactctcttctccaacctctcactatccatcaacctctttctcctttcaatcttggcaccatctttcaatctctcccttctcttaatttcagttccttcccttttctggtagagacaactcaggagatgcattttatccatgaacccaaaactccggcgccagtcacagactcgggaaggcagccttcccttggtgtttaatcacgtggggatacctgcctgattattcacacacatttcaggtgtgtctgaccacgcggggacgcctgccttggtccttcacccttagcggcaaatgccgcttttctgggggacaagaaccccctgaccccttctctccgtgtctctactctctcttttctctggacttgcctccttcactatgggcaaccttccaccctccattcctccctctactcccttagcctgtgttctcaagaacttaaaacctcttcaactcacacctgacctaaaacctaaatgccttattttcttctacaatgcaatctgaccacaatacaaactcgacagtggttccaaatagccagaaaaaggcgctttcgatttttccatcctacaagatctaaataattcttgtcataaaatgggcaaacggtctgaggtgcctgacatccaggcattcttttacacatcagtgcctccctagtctctgttcccaatgcgactagtcccaaatcctccttctttccctcccgcctgtcctctcagtcccaaccctaagggtcgctgagtatttgtaatcttccttttctacagacccatctgacttctcccctcctccccaggctgctcctcgccaggccaagccaggtcccaattcttcctcagcctctgctcccccaccctgtaacccttttatcacctcccctcctcacacccggtccagcttacagtttcgttcagcaactagccctccccgacctgtccagcaatttcctcttaaaaaaggtggctggagctaaaggcatagtcgaggttaatgctcctttttctttatccgacctctcccaaaatcagttagcatttaggctctttttcatcaaatatgaaaaacccagcccagttcatggctcattcggcagcaaccctgagatgctttatagccctagaccctaaaaggtcaaaaggccatcttattctcaatatacattttattaccaaatccgctcctgacattaaataaaactccaaaaattaaattccggccctcaaaccccacaaacaagacataattaacctcgccttcaaggtgtacaataatagagtagaggaagccaagtagcaatatatttctgagttgcaattccttgcctccactgtgaaagaaaccccagccacatctccacacacaagaacttccaaacgcctgaactgcagctgccaaggtttactccggaaatctggccactgggccaaggaatgcccacagcccgagattccccctaagccgtgtcctgtctgtgcgggaccccactgaaaatcggactcttcaactcacctggcagccgcttccagatcccctggaactctggcccaaggctctctgagtgactccttcccagatcttctcggcttagcagctgaagactgacactgcccaatcgccttggaagcctacaggacaatcacagatgctctgggtaactctcacagtggagggtaagtccatccccttcttaatcaatacggaggctacccactccacattacttcttttcaagggcctgtttcccttgcctccataactgttgtgggtattgacggccaggcttctaaacctcttaaaactccccaactctggtgcccacttagacaacattcttttatacactcttttttaagttatccccacctgcccagttcccttattaggccaagacattttaactaaattatctgtttccctgactattcctggactacagcaacacctcattgccacccttttccccatttcaaagcctccttcacatcctcctctcgtatccccccaccttaacccacaagtataggacacctctactccctccttggtgactggtcatgcaccccttaccatcccattaaaacctaatcacccttacccccctcaatgccaatatcccatcccacagcatgctttaaaaggattaaagcctgttatcacttgcctgttacagcatggccttttaaagcctataaactctccttacaattcccccattttacctgtcctaaaaccagacaaggcttacaggttagttcaggatctgcgccttatcaaccaaattgttttgcctatccaccctgtggtgccaaacccatatactctcctagcctcaatgcccccctccacaacccattattctgtctggatttcaaacatgctttctttactattcctttgcacccttcatcccagcctctcttcgctttcacttggactgaccctgacacccatcaggctcagcaaattacctgggctgtgctgccgcaaggcttcacagacggcccccattacttcaatcaagcccaaatttctttcaatcaagcccaaatttcttcctcatctgttacttatctcggcgtaattctcataaaaacacacatgctctccctgccgattgtgtccaactgatctctcaaaccccaacaccttctacaaaacaataactcctttccttcctaggcatggttagatactttcgactttagacacctggttttgccatcctaacaaaaccattatataaactcacaaaaagaaacctatctgaccccatagatcctaaatcctttccccactcctctttccgttccttgaagacagctttagagacttcccccaccctaactctccctgactcatcagaacccttttcattacccacagctgaagtgcaggactgtgcagtcagaattcttacacaagaactgggaccacaccctgtagcctttttatcccaacaacttgaccttactgttttgcctagccctcaagtctgcgtgcggcagctgccgctgccctaatacttttagaggcccttaaaatcacgaactatgatcaacagttctcataacttccaaaatctattttcttcctcacacctgacacatatactgtctgctccctggcttcttcagctgtactcactctttgttgagtctcccacaatcaccactgttcctggcccggacttcaatccagcctcccacattattccagataccacacctgacccccacgactgtatctctctgatccacctgacattcaccccatttccccatatttccttctttcttgttcctcaccctgatcacacttagtttattgatggcagttcccaccaggcctaatcgccacacaccagcaaaggcaggctatgctatagtacaagccactaccccgcctcttagaacctctcatttcatttccatcgtggaaatctatcctcaaggaaataacttctcagtgttccatctgctattctactactcctcagggattattctggccccctcccttccctacacatgaagctcggagatttgcccccacccaggactggcaaattagctttactcaacatgccccaagtcaggaaactaaaatacctcttggcctgggtagacattttcactggataggtagaggactttcccacagggtctaagaaggccaccatggtcatttcttcccttctgtcagacataattcctcagtttgggcttcccacctcttcacagtctgataacagaccagcgtttattagtcaaatcagccaagcattttttcagactcttggtattcagtgaaacctttacatcccttaccatcctcaatcttcaggaaaggtagaatggactaatggtcctttagaaacacacctcaccaatctcagccaccaacttaaaaaggactgtacaatacttttaccacttgcccttctcagaattcaggcctgtcctcggaatgctacaggttatagcccatttaagctcctgtatggatgctcctttttattaggccccagtctcattccagataccagaccaacttggactgtgccccaaaaaacttgtcatccctactatcttctctctagtcatactcctattcactgttctcaactactcctgcatgccctgctcttgtttacactgccggtttacactgtttctccaagccatcacagctgatatctcctggtgctatccccaaactgccactcttaactcttaacgtaaataaataatctttgctggcaaggctatgctgaacctccttaggcactctctaattagatgtcctgggtcctcccaattcttagtcctttaatacctgtttttctccttctcttattccatttagttttcaattcatacaaaaccatatccaggccatcaccaataattctacacaacaaatgtttcttctaacaaccccacaatatcaccccttaccacaaaatcttccttcagcttaatctctcccactccaggttcccatgccgccccaatcccgctcgaagcagtcctgagaaacatcacccattatctctccataccacccccaaaaattttcgccgccccaacactttacaactatttcggttttttttttttcttattaatataagaagacaggaatgtcaggcctctgagcccaagctaagccatcatatcccctgtgacctgcacatacacatccagatggccagttcctgccttaactgatgagattccaccacaagagaagtgaaaatggcctgttcctgccttaactgatgacattaccttgtgaaattccttctcctggctcacctggctcaaaagctcccccgccaagcaccttgtgacccccacccctgaccaccagagaacaacccccctttgactgtaattttcctttacctacccaaatcttataaaatggccccacccctatctcccttcgctgactctcttttttggactcagcccacctgcacctggctgaaataaacagccttgttgctcacacaaagcctgtttggtgttctcttcacagggacgtgagtaaaa

SEQ ID NO: 207 - DNA, 454 bp, Homo sapiens
ttagagtgcgtagctaggcaaacatgaatagggcaggaaaggcccctcacacccaggaatgtcagggtaccattgtctgaaattattagagaccaatgtctctctaaaataataattagtcacagccagtgccgggagaagcagtctcccaacagacagaagatacctgaagctggtgatcagcagcttcctgatacgaatgcagaagttgggcaagtgggctcaaacatgctcactaagaggaaaaatgacagagtttaactggtatatgaccttcctctaggaacactcaaatggtaaaggaaaaatgcctcgaatgagcatgtgcacaatttcagtaaacacactgtgcatgtggcccttcccaggtgctgacaagccactgcccatgtggacagcccaccccaaggaaaaatcaagagaggggagaaacaaaaccccagaagcatgccaa

SEQ ID NO: 208 - DNA, 336 bp, Homo sapiens
tgggtgaggaccaaagtaagcccaccccactaggaactatgttgaaaaatttcaaaaaaaggatttaagggagactatggagtactatgacaccaggaaaacttaaaactttgtgtaagatagactggccagcattagaggtgggttggccattagaaggaagcctggacaggtcccctgtttcgaaggtatggcacaaggtaacctgtaagccaaggcacccagaccagttcccgtacatagacacttgattacagctggttttagaccccccgcccccaacacacagtggttgagagaacagcagcataagcagctggcagaggcaaggaaaga

SEQ ID NO: 209 - DNA, 5687 bp, Homo sapiens
gtcaggcctctgagcccaagctaagccatcatatcccctgtgacctgcatgtacacatccagatggcctgttcctgccttaactgatgacattccaccacaaaagaaatgaaaatggcctgttcctgccttaactgatgacattatcttgtgaaattctttctcctggctcatcctggctcaaaagctcccctgagcaccttgtgacccccactcctgcctgccagagaacccccctttttcctttacctacacaaatcctataaaacggccccacacctatctcccttagctgactctcttttcaggctcagcccgcctgcacccaggtaaaataaacagccttgttgctcacacaaagcctgtttggtggtctcttcacacggacgcacatgaaatttggtgccgtgactcggattgggggacctcccttgggagatcaatcccccgtctttgctccctgagaaagatccacctacaacctcaggtcctcagacccaccagcccaaggaacatcacaccaattttaattcaggtaagcagcctctttttactctcttctccaacctccctcactatccctcaacctccttctcctttcaatcttggtgccacacttcaatctctcccttctcttaatttcaattcctttcattttctggtagagacaaaggagacacgttttatcagtggacccaaaactccggtgccggtcatggactagggaaggcagccttcccttggtgtttaatccttgcagggacacctctctgattattcacccaggtttcagaccacgcagggatgcctgccttggtccttcacccttagcggcaagtcccgcttttctgggggaggggcagggaccgcgacctcttatctctgcacccggatcccttatttccatgctccaacctcttatctctgtgccccaaccccttatttccatgcccttctctgcttttctggagggcaagaaccccccaccccttctccgtgtctctactctcttttctctgggcttgcctccttcactataggcaaccttccaccttccgttcctccttcttctcccttagcctgtgttcttaagaacttaaaacctcaactctcacctgacctaaaatctatgcgtcttattttcttctgcaatgctgcttgaccccaatacgaactcgacagtagttctaaatagccagaaaatggcactttcaatttttccatcctacaagatctaaataattcttgtcataaaataggcaaatggtctgaggtgcctgacatccaggcattcttttacacatcagtccttccctagtctctgttccgaatgcaacttttccgaaatcttccttctttccctcctgcctgtccactcagttccaaccccaaccgtcactgagtctttctaatcttccttttctacagacccatctgacctctcccctcctcgctaggctgagctaggtcccaattattcctcagcctccgctcctccaccctataatccttttatcacctcccctcctcacacccagtccggcttacagtttcattcctcgactagccctcccccacctgcccagcgatttactcttaaaaaggtggctggagctaaaggcatagtcaaagttaatgctcctttttcttcatcccagatcagatagcgtttaggctctttttcatcaaatataaaaacccagcccagttcatggcttgtttggcagcaaccctgagatgctttacagccctagaccctaaaaggtcaaaaggccgtctattctcaatatacattttattacccaatccactcctgacattaaataaaactccaaaaattaaattccagccctcaaaccccacaacaggacttaattaacctcaccttcaaggtgtacaataatagagtacaggcagccaagtagcaatgtatttctgagttgcaattccttgcctccactgtgagacaaaccccagccacatctccagcacacaagaactccaaatgcccgaaccgcagctgccaggggttcctccagaacctcctcccccaggagcttgctacatgtgccggaaatctggccactggtccaaggaatgcccacagcctgggattcctcctaagccacgtcccgtcggtgcgggaccccactgaaaatcggactgttcaactcacctggcagccactctcagagcccctggaactctggcccgaggctctctgactgactccttcccagatcttctcagcttagtggctgaagactgacgctgcctgattgcctcagaagccccctagaccatcatggacgccgagcttcgggtaactctcatagtggagggtaagtccatccactccttaatcaatacggaggctacccactccacattaccttcttttcaagggcctgtttcccttgcctccataactgttgtaggtattgacggccaggcttctaaacctcttaaaactccccaactctggtgccaacttagtcaatactcttttaagcactcctttttaattatccccacctgcccagttcccttattaggctgagacactttaactaaatcatctgcttccctgactattcctgggctacagccacaccttattgctgccttttcccccagttcaaagcctccttcacatcctccccttgtatctccccacctaagacacctctactccctccttagcgaccgatcatgcaccccttaccatctcattaaaacctaatcacccttacccctctcaatgccaatatcccatcccacagcacgctttaaaaggattaaagcctgttatcactcgcctgctacagcatggccttttaaggcctataaactctccttacaattccccctttttacttgtcctagaaccagacaagccttacaggttagttcaggatctgcgccctatcaaccaaattgttttgcctatccaccctgtggtgccaaatccatatactctcctatcctcaatacctccctccataacccattattctgttctggatctcaaacgtgctttctttactattcctttgcacccttcatcccagcctctctgctttcacttggactgaccctgacacccatcaggctcagcaaataacctgggctgtactgcaccaagtcttcacagacagcccccattacttcagtcaagcccaaatttcttcctcatctgttacctatctcagcataattcttcataaaaacacatgtgctctccctgccgatagtgtccgactgatctctcaaaccccaaccccttctacaaaacaacaactcctttccttcctaggcatgcttggatactttcgcctttggatacctggttttgccatcctaacaaaaccattatataaactcacaaaaggaaacctagctgaccccatagatcctaaatcctttccccactcctctttccattccttgaagacagctttagagactgcccccaccccagctctccctgactcatcccaacccttttcattacacacagctgaagtgcagggctgtgcagtcggaattctcacacaaggaccaggatcatgtcctgtagcctttttgtccaaacaacttgaccttactgttttaggctggccatcatgcctccgtgcagtggctgctgctgccctaatacttttagaggcccttaaaatcacaaactatgctcaactcactctctacagctctcataatttccaaaatctattttcttcctcacacctgacgcatatactttctgctccctgctccttcagctgtacttactatttgttgagtctcccacaattaccattgttcctggcctggacttcaatccggcctcccacattattccaggtaccacacctgaccctcatgactgcatctctctgatcaaactgacattcaccccatgtccccatatttccttttttcctgttcctcaccctgatcacacttagtttattgatggaagttccatcaggcctaatcaccacacaccatcaaaggcaggctatgctatagtacaagccactagcctgcctcttaaaacctctcatttcctttccatcatggaaatctatcctcaaggaaataacttctcagtgttccatctgctattctactgcttctcagggattattcggtccccctcccttccctacacatcaaactcgaggatttgcccccacccaggactggcaaattagctttactcaacatgccccgagtcagataactaaaatacctcttagtctaagtagacactttcactggataggtagaggcctttcctacagggtctgaggaggctaccgcagtcatttcttcccttctgtcagacataattcctcagtttagcctttccacatctataccgtctgataacagaccagcctttattagtctaatcagccaagcagtttttcagtctcttagtattcagtgaaacctttatatcccttacggtcctcagtctgcaggaaaggtagaacagattaatggtcttttaaaaacacacctcaccaagctcagccaccaacttaaaaaggactggacaatacttttaccactttcgcttctcagaattcaggcctgtcctcagaatgctacagggtacagcccatatgagctcctgtatagacactcctttttattaggccccagtcttattccagacaccagaccaacttggactgtgtcccaaaaaacttgtcatccctactatcttctgtctagtgatactcctattcaccgttctcaactactcatacatgccctgctcttgtttacactgccagtttacagtttctccaagccatcacagctgatatctcctggtgctatccccaaactgccgctcttaactcttgaagtaaataaataatctttgctggcaggactacgctgaacctccttaggcactctctaataagatgtcctgggtcctcccaattcttagacatttaattcctgtttttctccttctcttattccgtttagtttttcaattcatacaaaaccatatccaggccatcaccaataattctacacaacaaatgtttcttctaacaaccccacaatatcaccccttaccacaaaatcttccttcagcttaatctctcccactctaggttcccatgccgcccctaatcccgctggaagcagccctgagaaacatcgcccattatctctccataccatcccccaaaattttctctgtcccaacactttaccactatttcattttatttttcttattaatataagaagacaggaatgtcaggcctctgaggccgagttaagccatcatatcccctgtgacctgcatgtacacatcctgatggcctgttcctgccttaactgatgacattccaccgcaaaagaaatgaaaatggccgttcctgccttaactgatgacattatcttgtgaaattccttctcctggctcatcctggctcaaaagctcccctactgagcaccttatgacccccactcctgcctgccagagaacaaccccgctttttcctttacctacccaaatcctataaaacggccccacccctgtctcccttagctgactcttttcagactcagcccgcctgcacccaggtgaaattaatagccttgttgctcacacaaagcctgtttggtggtctcttcacagggacgtgcatgaaa

SEQ ID NO: 210 - DNA, 4734 bp, Homo sapiens
gtcaggcctctgagcccaagctaagccatcatatctcctgtgaccaggacgtacacatccagatggccggttcctgccttaactgatgacattaccttgtgaaattccttctcctggctcatcctggctcaaaaagctccccgactgagcaccttgtgacccccactcctgcctgccagagaacaaccccctttgactgtaattttcctttacctacccaaatcttataaaacggccccacccctatctccctttgctgactctcttttcagactcagcccgcctgcacccaggtgaaataaacagccttgttgctcacacaaagcctgtttggtggtctcttcgcacggacgtgagtgaaattttggtgccgtgacttggatcaggggaacctcccttgggagatcagttccctgtcctcctgctctttgctccataagaaagatccacctatgacctcaagtcctcagaccgaccagcccaaggaacatcacaccaattttaaatcaggtaagtggcctctttttactctcttctccaacctctctcactatccctcaacctctttctcctatcaatcttggcgccacacttcaatttctcccttctcttaatttcagttcctttccttttctggtagagacaaagggagacacattttatccgtagacccaaaactccggcgccagtcacagacttggaaagacaggcttcccttggtgtttaatcacgcggggatgcctgacccacatttcagaggtgtctgaccaggcaaggatgcctgctttagtccttcacccttaccggcaagtaccgcttttccagggggcaagaaccccccgaccccttctctctgtgtctctacccttctccgcttttctaggaggcaagaaccccctgaccccttctctccatgtctctaccccttctccgcttttctaaggggcaagaaccccccgaccccttctctccatgtctctaccccttctctgcttttctggaaggcaagaaccccccgaccccttctctccgtgtctctactccttctccactttcctaaaaggcaagcaccccccaccccttctctccgtctctctactctctctttcctctaggcttgcctccttcactatgggcagccttccaccctccattcctcctccttctcccttagcctgtgttctcaagaatttaaaacctcttcaactcacacctgacctaaaacctaaatgccttattttcttctacaatgccgcttgaccccaatacaaacttgacagtggttccaaatagccagaaaatggcactttcgatttttccaccctacaagatctaggtaattcttgtcgtaaaatgggcaaacggtctgaggtgcctaacatccaggcattcttttacacattgttccctccctagtctctgtccccaatgtgactcatcccaaatcctccttctttccctcccgcctgtcccctcagtcccaaccccaagcgttgctgagtctttctagtcttccttttctacagacccatctgacccctcccctcctccccaggctgctcctcgccaggctgagccaggtcccaattcttcctcagcctctgctcccccaccctataatccttttatcacctcccctcctcacacctggtctggcttacagtttcattccacgactagccctcccccacctgcccagcaatttcctcttaaaaaggtggctggagctaaaggcacagtcaaggttaatgctccttctttattcgacctctcccaagtcaattagcgtttaggctctttcatcaaatatgaaaaacccagtccagttcatggctcattcagcagcaaccctgagatgctttacagccctagaccctaaaaggtcaaaaggccgtcttattctcaatatacattttattacccaatccgctcctgacattaaataaaactccaaaaattaaattccggccctcaaacccacaacaggacttaaccttgccttcaaggtgtacaataatagagtagaggcagccaagtagcaatgtatttctgagttacaattcgttgcctccactgtgagacaaaccccagccatatctccagcacacaagaacttccaaacgcctaaaccgcagcagccaggcattcctccagaacctcctcccccaggagcttgccacaagtgccagaaatctggccactgggccaaggaatgcccacagcctggtattcctcctaagctgtttcccatctgtgcaggaccccactgaaaatcggactgttcaactcacctggcagccacttccagagcccctggaactctggcccaaggctctctgactgactccttcccagatctcggcttagcagctgaagactgatactgccgaatcgcctaggaagcctacaggaccatcacagatgctctgggtaactctcacagtggaaggtaagtccctccccttcttaatcaatagggaggctacccactccacattaccttcttttcaagggcctgtttcccttgcctccataactgttgtaagtattgatggccaggcttctaaaccccttaaaactcccccactctggtgccaacttggacaacattcttttatgcactcttttttagttatccccacctgcccagctcccttattaggccgagatattttaaccaaattatctgcttccctgactattcctggagtacagccacatctcattgccaccattcttcccaacccaaagcctcctttgagtcttcctctcgtatccccctagcttaacccacaagtataggacatctctaccccctccctggcaaccgatcacagcccattaccatcccattaaaacctaatcacccttacccggctcaacgccaatatcccatcccacagcacactttaaaaggattaaagcctgttatcactccctgctacagcatgggcttctaaaacctataaactctccttacaattcccccatttcacctgtccaaaaaccggacaaggcttacaggttagttcaggatctgcaccttatcaaccaaattgttttgcctatccaccccctggtgccaaacccatatactctcctatcctcaatacctccctccacaacccattactctgttctggatctcaaacgtgctttctctactattcctttgcacccttcatcccagcctctcttcgctttcacttggactgaccctaacacccatcaggctcagcaaattacctgggctgccgcaaggcttcacagacagcccccattacttcaatcaagcccaaatttcttcctcatctgttacctatctcggcataattcttcataaaaacacacgtgctctccctgccaatcgtgtccaactgatctctcaaaccccaacaccttctacaaaacaacaactcctttccttcctaggcgtggttagatactttcgactttagatacctggttttgccatcctaacaaaaccattatataaactcacaaaaagaaacctagctgaccccatagatcctaaatccttttcccacacctctttccgttccttgaagacagctttaaagactgccgccaccctagctctccctgactcatcccaacccttttcattacacacagccgaagtgcagggctgtgcagtcggaatttttacacaaggaccaggatcgtgtcctgtagcctttttgtccaaacaacttgaccttactgtttcaggctggccaccatgtctccatgcagcggctgccactgccctaatactttcagaggccttgacttactcactgctgaaaaaggaggactctgtatattcttaaatgaagagtgttgtttttacctaaatcaatctggcctgttgtatgacaacataaaaaaactcaaggatagggcccaaaaacttgccaaccaagcaagtaattatgctgaacccccttattcactctctaattggatgtcctgggtcctcccaattcttagtcctttaatacctatttttctccttcttttatccagaccttgtatcttccgtttagtttctcaattcatccaaaaccgtatccaggccatcaccaatcattctatatgacaaatgtttcttctaacacaatatcaccccttaccacaaaatctcccttcagcttaatctctcccactgtaagttcccacgccgcccctaatcccactcaaagcagccctgagaaacatcgcccattatctctccataccaaccccaaaaattttcgctgccccaacactttaccactattttgttttatttttcttattaatataagaagacaggaatgtccggcctctgaacccaagctaagccatcatatcccctgtgacctgcaggtacacatccagatggccagttcctgccttaactgatgacattccaccacaaaagaagtgaaaatggccggtccttgccttaactgatgacattaccttgtgaaattccttctcctggctcatcctggctcaaaaagctcccacactgagcaccttgtgacccccactcctgcccgccagagaacaagcccctttgactgtaattttccttaacctacccaaatcttataaaacggccccacccctatctccctttgctgactctcttttcggactcagcccgcctgcacccaggtgaaataaacagccttgttgctcacacaaagcctgtttggtggtctcttcacacggacacgagtgaaa

SEQ ID NO: 211 - DNA, 3122 bp, Homo sapiens
acttgtgtttcaccagaaaaaaatcagcttcctgtttgaatacccactagacatttaaagttctacaataaacccatcgaagatgcaaaaaaagcgcctctgcaaaaacaaaaaacccacaatcaagcatcatcgactccccaagtaaacaaaatggtaatatcaaaaaaacagataaagctgtcatccaccaaaaaagcggagctgccgacctggggtccactaaagaagctgacacagttagctaaaaaaagcctaaaaaaacaagggtaatacaaactctagaaaatatactggttacagctttgataattgtatcaacggtggtaagtctcctcatgtctgcagaaacagctgcagctaattatacttactgggcctatgtgcctttcctgtccttaatttgggcagtcacatggataaataatcctattaaagaatatgttaataatagtgcgtgggtaccaggccccacagatgatcgttgccgtgcccaatcaaaaaaaaaaaaagaaataataataaatatttccattgggtattattatccccctatttgcctagaaaaggcaccaggatgcttaacgcctacaacccaaatttggtgggtagaagtacctactgtcagtgccaccagtagatttacttatcacatggtaagtgaaatgtcactggagccacagataaataatttacaggactcttcttatcaaagatcattaaaatttaggcgtaaggggaagccttgccccaagaaattcccaaaaaatcaaaaggcccaaaagtcttagtttggaaaaaatgtgtgactgatactgctgtggtattacaaaacaataaattggaaactattataaactgggcccctcgaggccaattatattataattgtacaggccagactcactcatgttcacaggccccatccatctggcccattcatccagcctctattagtgatttaactaaaaggcaagaccaggttttataaaggtttaaatcaccctatccataaaaatggggtaaaaagagaatttcatcacctcaaccaaagttagttcgtcctgttactagtcctaaacatccaaaattataaaaacttactgtggctttgcaccacgttaaaatttggtctggaaatcaagctataaaaccaaaaagtcgtaagccatattatactatcaacctaaattccaatttaacaattcctttacaaagttgtgtaaaacccccttatatactagttgtaaaaaacacagttattaaaccagattcccaaactataacctgtgaaaattgtagattgtttacttgcattgattcaacttttaattggcagcaccatattctgctagtgagggcaagagagggcatgtggatccctgtgtccatagaccgaccatgagagtcttccccatctgtccgtattttaacaaaagtattaaaaaaagttctaactagatccaaaagattcatttttactttaattatgtgattatgggtcttattgcagtcacagctactgctgcggctgctggaattgctttacactcttctattcaaactgctaaatatgtaaataattggcaaaagaattcctcaaaattgtgcaattctcagacccaaatagatccaaaattggcaaaccaaattaataatcttagacaaactgtcatttaaatgagagataggctccatgagcttgaaatatctttttcagttacagtgtgactgaaatacgtcagatttttgtattacaccccgagcctataatgactctgaacatcaatgggacatggttaaacgccatctacaaaacagaaaaaataatcttactttaaatatttcaaaattaaaaaaccaaatttttaaggcatcaaaagcccatttaaatttggtaccaaaaactaagacaattgtaaaagctgttgatggcctcacaaatcttaacctcgtcacttgggttaaaactatcaaaagttccactattgtaaatttgtattaatccttgcatgcctgttctgtctgttgttagtttacaggtgtatctaacagctccaaaaagacaacgaccaacaaaaacaggccataatgactatggcggttttgtcaaaaagaaaagggggatatgaagggaaaagaaagagagatcagactgttactgtgtctatgtagaaaaggaagacataagaaactccgttttgacctgtaccctgaacaattgctttgccctgatatgctgttaatctgtaactttgccccaaccttgtgctcacaaaaacatgtgttgtatggaatcaaggtttaagggatctagggctgtgcaggatgtgccttgttaacaaaatgtttacaggcagtatacttggtaagagtcatcgccattctcccatctcaataaaccaggggcacaatgcactgcggaaagccgcagggacctctgccctggaaagcccggtattgtccaaggtttctgcccatgtgatagtctgaaatatggcctcatgggatgggaaagacctgaccatcccccagcctgacacccgtgaagggtctgtgccctggaggattagtaaaagaggaaggcctctagcagttgaaataagaggaaggcctctgtctcctgcctgcccctgggaagggaatgtcttggtataaaacccgattgtacatttgttcgattctgagataggagaaaaactgccctgtggtgggaggcgagacatgttggcagcaatgctgctttgttattctttactccactgagatgtttgagtggaaaaaagcataaatctggcctatgtacacatccagacatagtaccttcccttaaacttatttgtgacacagattcctttactcacattttcttgctgaccttcgctccactatcaccctgctctcctgccacattcctctcactaaaatagtaaaaatagtaataaatactaagaaaactcagagactggtgctggtgtaggtcctccatatgctgaacaccagtcccctgggcctacttttttttctctatactttgtctctgtgtcttatttcttttctcagtctcttgtcccacttgatgagaaatactcacaggtgtggaggggcaggccaccctttca

SEQ ID NO: 212 - DNA, 975 bp, Homo sapiens
gtcagggaaagaaagagagatcagactgttactgtgtctatgtagaaagaagacataagaaactccattttgttttctactaagaaaaattattctgccttgagatgctgttaatctgtaactttagccccaaccctgtgctcacagaaacatgtgctgtgttgactccaggtttaatggatttagggctgtgcaggatgtcctttgttaaaaatgtgtttgcaggcagtatgcttggtaaaagtcatcaccattctctagtttcgagtacccagggacacagtgcactgcagaaggccgcagggacctctgcccaagaaagcctgggtattgtccaaggattctccccactgagacagcctgagctatggcctcatgggaagggaaagacctgaccatcccccagcccggcacccataaagggcctgtgctgaggaggattagtgaaagaggaaggcctctttgcaattgagataagaggaaggcatctgtctcctgctcatccctgggaatggaatgtctcggtgtaaaactcgatcatacattatatttactgagataggagaaaaccgccttatggctggaggtgagacatgctggtggcaatactgctctttaccgcactgagatgcttgtgtaaagtcaaacataaatctggcctactctcacatcaaggcacagctcctttccttaaccttatttatgacacagagacctttgctcacatgtttccctgctgaccctctctccaccattaccctatagtcctgccacatccccctcaccgagatagtagagatagtgatcaataaatactgagggaactcagagaccagtgccagcgctggtccttcgtatgctaagcgctggtcccctgggtccactcttctctctctatactttttctctgtgtcttatttcttttctcagtctctcatcccacctgacgagaaatagccacaagtgtggaggggc

SEQ ID NO: 213 - DNA, 930 bp, Homo sapiens
agaacactcaaagctcaaatggctaaacaaaaaaaggaaaaagacagtaaggagtataacactccccagatgcaacttaatctaacactctacactttaaattttctaaacatacatagaaatcagaccactacttctgcagaacattttactggtaaaaagaacagcccacatgaggaaaactgatttggtggaaagacaacaaaaacaaaacatgggaaataggtaaggtgataatatgggggagaggttttgcttgtgtttcaccaggagaaaatcagcttcctgtttggatacccactagacatttgaagttctataatgaacccatcagagatgcaaatgaaagtgcctccgcagagacagaaaacccgcaatcgagcatcatcgactcgcagggtgaacaaaatggtgatatcagaagaacagatgaagttgccaaccaccaagaaaacgacacatgtggagagccagggagaggaagagaaagaaaaagagacagagatcagagagagacacagaaagtgagcctggggagagagatagtataaaagagagagactgtaagaaaagggagacaaagagataaaaggtgtgagagaacaggtgaggagaaagaccgaaaactatgagaaacagcaactaagacacaaaggaggtggcagaccgcctgggtgccacagcacccacaccgtcctcttgccccctgtcacttgggttaaaaccacaggaaattccactgttgcaaattttgtattaatccttgtatgtctgtcctttctattgttagtctacaggtgtatccagcagctccagagagacagcaaccagcgagaaggggccatgatgatggtggtggttttgtcaaaaagaaaagggggatatgcagggaaaagaaagagagatcagacagttactgtgtctatatag

SEQ ID NO: 214 - DNA, 4303 bp, Homo sapiens
gtcaggcctctgagcccaagctaagccatcatatcccctgtgacctgcacgtacacatccatatggccggttcctgccttaactgatgacattccaccacaaaagaagtgaaaatggcctgttcctgccttaactgatgacattatcttgtgaaattccttctcctggctcatcctggctcaaaagctcccctactgagcacctcgtgacccccactcctgcccgacagagaacaacccctttgactgtaattttcctttacctacccagatcctataaaatggccccacccccatctccctttgctgactctcttcgaactcagcctgcctgcacccaggtgaaataaacagccttgttgctcacacaaagcctgtttggtggtctcttcacacggacgcacatgaaatttggtgccatgactcgaatcgggggacctccttgggaggttgggggatctcccttgggagatcaatcccctgtcctcctgctctttgctccatgaaaaagatccacctacgaccttgggtcctcagacccaccagcccaaggaacatctcactaattttaaattgggtaagcggcctcttcttactctcttctccaacctctctcactatccctcgaccactttctcctttcaatcttggcaccacccttcaatctctcccttctcttaatttcagttcctttccttttctggtagagacaggagacgcattttatctgtggacccaaaactctggtgcctgtcacggactcgggaagacagtcttcccttgatgtttatcacgcgaggacgcctgcctgattattcacccacgtttcagaggtgtccaaccacgcagggacgactgccttggtccttcacccttagcagcaagtaccgcttttctggggggcaagaaccccccaaccccttctccttcaccctgagtggcaagtgccgcttttctagggggcaagaaccccccgatcccttatttccacgccctgaccccttatctccacaccctgaccccttatctctgtgccccaaccctttatttccacaccccgacccctttcccacttttctggagggtaagaacccccgaaccccttccctccgtgtctctactctctcttttctctaggcttgcctccttcactatgggcaaacttccaccctccattcccccttcttctcccttagcctgtgttcttaaaaacctaaaacctcttcaactcacacctgacctaaaacctaaaggccttattttcttctacaatgccgcttgaccccaatacaaactcgatagtggttccaaacagccagaaaacagcactttcattttttccatcttacaagatctaaataattcttgtcataaaatgggcaagtggtctgaggtgcctgacgtccaggcattcttttacacatcagtcctccctagtctgtgttcccaatgcaactcgtcccaaatcttccctctttccttcccgcctgtcccctcagtcccaaccccaagtgtcgccgagtctttctaatcttccttttctacagacccatctgacctctctcctccatgccaggcccagctaggtcccaattcttcctcagcctctgctcctccaccctataatccttttatcacctcccctcctcacacccagtctggcttacagtttcgttccatgactagccctcccccacctgcccagcaatttcctcttaaaaagtagctggagctaaaggcatagtcaaggttaatgctccttttctttatcccaaataagagagcatttaggctctttttcatgaaatatgaaaaacccagcccagttcatggctcatttggcagcaaccctgagacactttacagccctagaccctaaaaggtcaaaaggccgtcttattctcaacacacattttattacccaatccactcccgactttaaataaatctccaaaaattaaattccggccctcaaaccccacaacaggacttaattaacctcaccttcaaggtgtacaaaaatagaaaaaagttgcaattccttgcctccactgtgagacaaaccccagccacatctccagcacacaagaacttccaaatacctgaaccacagcagccaggcgttcctccagaacctcctcccccaggagcttgctacaagtgctggaaatctggccactgcgccaaggaatgcccacagcccaggattcctcctaagccgtgtcccatctgtgcgggacccccaagaaaatcggactgttcaactcacctggcagccacttccagagcccctggaactctggcccaaggctctctgactgactccttcccagatcttctcggcttagcagctgaagactgacactgcccaatcacctcagaagcctacaggaccatcacagacactctaggtaactctcacagtggagggtaagtccgtccccttcttaatcaatacggaggctacccactccacattaccttcttttcaagggcctgtttcccttgcctccataactgttgtgggtattgatggccaagcttcaaaacccctgaaaactcccccactctagtgccaacttggacaacactcttttatgcattcttttttagttattcccacctgcccagttcccttattaggccgagatattttaagcaaattatctgcttccctgactattcctggactacagccacatctcattgccgcccttatccccaacccaaagcctcctttgcgtcttcctctcatatcccccaaccttaacccacaagtataggacatctctactccttccctggcaacggatcacatgcccattaccatcccattaaaacctaattacccttaccccgctcaacgccaatatcccatcccacagcacgctttaaaaggattaaagcctgttatcactcacctgctacagcataggcttctaaaacctataaactctccttacaattcccccattttacctgtccaaaaaccggacaagtcttacagattagttcaggatctgtgccttatcaaccaaattgttttgcctatccaccctgtggtgcccaacccgtacactcttttgtcctcaataccttcctccacaactcactattccattcttgatcttaaaaatgcttttttcactatccccctgcacccctcgtcccagcctctctttgctttcacctggactgacgctgacacccatcagtcccagcagcttacctgggctgtgttgccgcaaggtttcagggacagccctcattacttcagccaagctctttctcatgatttactttctttccacccctccgcttctcaccttattcaatatattgaggatcttcttctttgtagcccctcctttgaatcttctcaacaagacacacttctgctccttcagcatttattctccaaaggatatcaggtatccccctccaaagctcaaatttattgtccatccattacctaccttggcataattcttcataaaaacacacgtgctctccctgccgatcatgtccaactgatctctcaaaccctaaccccttctacaaaacaacaactcctttccttcctgggcttggttggatactttcgcctctggatacctggttttgccatcctaacaaaaccattatataaactcacaaaaggaaacctagctgaccccatagatcctaaatcctttccccactcctctttccattccttgaagacagctttagagactgcccccaccctagctctccctgactcatcccaacccttttcattacacacagccgaagtgcagggctgtgcagtcggaattcttacacaaggaccgggatcatgtcctgtagcctttttgtccaaacaacttgaccttactgttttaggctggtcatcatgtctctgtgcagtggctactgctgccctaatactttagaggcccttaaaatcacaaactatgctcaactcactctctacagttctcataacttccaaaatctattttcctcctcacacctgacacatatactttctgctccccggctccttcagctggactcactctttgttaagtctcccacaattacccttgttcctggcccagacttcaatccggcctcccacattattcctgataccacacctgaccaccatgactgtacctctcttatccaccagacattcaaccccatttccccatatttccttctttcctgttcctcaccctgatcacacttgatttattgatggcagttccaccaggcctaatcgccacacaccagcaaaggcaggctatgctacagca

SEQ ID NO: 215 - DNA, 423 bp, Homo sapiens
gtcaggcctctgagcccaagctaagccatcatatcgcctgtgacttgcaggtatacatccagatggcctgaagcaactgaaggatcacaaaagaagtgaaaatagccatttcctgccttaactgatgacactccaccattgtaatttgttcctgccccaccttaactgattgattaacattgtgaaattccttctcctggctcagaagctccccaactgagcaccttgtgacccctgcccctgcccacaagagaacaaccccctttgagtgtaattttccactacctacccaaatcctataaaacggccccacccctatctcccttcgctgactcctttttcgaacacagcctgcctgcacccaggtgattaaaaagctttattgctgacacaaagcctctttggtggtctcttcacatggac

SEQ ID NO: 216 - DNA, 668 bp, Homo sapiens
ttaccataggtagttaggcagacatgagcagggaaggagagggccctcttcaccaggaatgtcaggcgaccataaggtgatagtgaggtggttgttaaactgtctctaaaataataattggttgcagccagcgccagggaaacgcagtctcccaatagatagaaaacacctgaaactgatgatcagcagcttcctgattagatggcaggagttgggtgagtgaactcaagcatgcacactaagaggcaaaatggtggaattaactggtacctcaccttccttagggaatactcaaccggtaagggaaaaatgtttcaaggcggcctgaatacaactttagtaaacacactgcacacgtggcccctcctaagtgctggcaggccaccccaagggaaggatcaggggagaagggcacaatcaccccagaagcataaaaacccaagtcaacggtcaaaccttgcacttgatctctcaagtcacccgcttgcccctcttccaagcgtacttcacttcctttcattcttgctctaaaacttcttaataaactttcactccttcccttaagcttgcctcagtttctccctctgccttattccctttggttgaattctttcttctgaaggaggtaagaattgaggttgctgcagtcttgtgtggattcaccactg

SEQ ID NO: 217 - DNA, 977 bp, Homo sapiens
gtggggaaaagaaagagagatcagactgttacagtgtctatgtagaaagaagtagacatgagagactccattttgttctgtactaagaaaaattcttttgccttgagatgctgttaatctgtaaccctacccccaaccctgtgctcgtagaaacaagtgctgtgtgctgtgtcgactcaaggtttaatggatttagggctatgtaggatgtgctttgttaaacaaatgcttgaaggcagaatgcttgttaaaagtcatcaccactccttaatctcaagtaccaagagacacaaaacactgcagaaggccgcagggacctctccctaggaaagccaggtattgtccaaggtttctccccatgtgatagtctgaaatatggcctcgtgggaagggaaagacctgaccatcccccagcccgccacctgtaaagggtctgtgctgaggaggattagtaaaagaagaaggcctctttgcagttgagataagaggaaggcatctgtctcctgctcgtccctgggcaatggaatgtctcagtgtaaaacctgattgtatattccatctactgagataggagaaaaccgccttagggctggaggtgagacatgctggcggcaatactgctctttaaggcattgaggtgtttacatatgtgcacatcaaaagcacagcacctttttctttaccttgtttatgatgcagagacatttgttcacatgttttgctgctgaccctctctccactattaccctgttgtcctgccacatccccctctccgagatggtagaggtaatgatcaataaatactgagggaactcggagaccagtgctggcacgggtcctccgtatgctgagcgctggtcccctgggcccacttttctttctctgtactttgtctctgtgtctctttgttttctcaagtctctcgttccacctgacgagaaacagccacaggtgtggaggggcaggccaccccttca

SEQ ID NO: 218 - DNA, 4871 bp, Homo sapiens
gtcaggcctctgagcccaagctaagccatcatatcccctgtgacctgcacgtatacatccagatggcctgaagcaactgaagatccacaaaagaagtgaaaataaccttaactgatgatactccaccactgtgatttgtttctgccccaccttaactgatcaacgtgctttgtaatcgcccccacccttaagaaggttctttgtatttctccccacccttgagaatgtactttgttagatccaccccctgccacaaaacaccactcctaactccaccgcctatcccaaaacctgtaagaactaatgataatcccaccaccttttgctgactctctttttggactcagcccgcctgcacccaggtgaaataaacagccttcttgctcacacaaagtttgtttggtggtctcttcacactgacgcgtgagacatttggtgctgaagacccgggtcagagggactccttcggaagaccagtcccctgtcctcgcctcactccatgaggagatccacctacaacctcgggtcctcagaccaaccagcccaaggaacatctcaccaatttcaaatcgggtaagcggtcttttcactctcttctccagcctctctcgctacccttcaatctccctgcccttccaattccagttctttttcctctctagtagagacaaaggagacacattttatccatggacccaaaactctggcgccagtcacagactcgggaagacagccttcccttggtgtttaatcattgcagagacgcctgcctgattattcacccacaattcactggtgtctgatcactgcagggacgcctgccttggtcattcacccacattcccatggtggcaagtcaattgcggggatgcctgctttggctcctcacccacactgcagcccagggctgctccccaccaccccgcttctccgtgtctctacctttctctttaaacttaccttcttcactatgggcaaccttccaccctccattcccccttcttctcccttagcctgtgttctcaagaacttaaaaccccttcaactcacacctgacctaaaacctaaatgccttattttcttctgcaataccgcttgaccccaatacaaactcgataatggttctaaatagccagaaaatccattttacaagatctagataatttttgtcgaaaaatgggcaaatggtctgaggtgcctgacatccaggcattcttttacacattggtccctccctagtctctgctcccaatgcgactcatcccaaatctttcttctttctctcctgtctgttccttcagtctccacaccaagctctgagtcctttgaatcctccttttctacagacccatatgacctctcctccccaggctgctcctcaacaggctgagccaggtcccaattcttcctcagcctctgctccccgaccctataatctttttatcaactcccctcacacccattctggcttacagtttcattccgcgactagccctcccccacctgcccaacaatttcctcttaaaaaggtgactggagctgaaggcatagtcaaggttaatgttcctttttctttatccgacctctcccaaatcagttagcgtttaggctctttttcatcaaatataaaaacgcagcccagtccatggcccgtttggcaacaaccctttgacgttttactgccctagacccacaggggccagaaggctgtcttattctcaatatacattttattaaccagcccactcccaacattaaaaaaagctccagaaattagattctggccctcaaaccccacaagaggacttaattaacctcgccttcaaggtgtacaataatagagtagaggcagccaagtagcaatgtatttctaagttccagttccttgcctccactgtgagacaaaccccagctacattgccagcacacaagaactccaaacacctgaagtgcagctgccaggggttcctccagaacctcttccccaggagcttgcttcaagtgccagaaatctggccactgagccaaggaatgccctgcagcccgggattcctccttagccgtgtcccatttgtacaggaccctactggatatcagactgtccaactcgcccggcagccactcccagagcccctggaactctggcccaaggctctctgactgacttcttcccagatcttctcagcttagtggctgaagaccgacgctgcccgatcgcctcagaagcttcctggaccatcacagacgctctgggtaactcttacagtggagggtaagtccgtctccttctaaattaatatggaggctacccactccacattaccttattttcaacgacctgtttcccttgcccccataactgttgtgggtattgatggccaggcttctaaacctcttaaaactccccaactctgatgccagcttggacaacattcttttatgcactcctttttagttatccccacctgcccagctcccttattagatcaagacattttaactaaattatctgcttccctgactattcctaagctacagccacacctcattgccacccttcttcccaacccaaagcctccttcacatcttcctcttgtatccctccaccttaacgcacaggtacgggacacctctactccctccctagcaaccgatcacatgccccttaccatcccattaaaacctaatcacccttaccccgctcaatgccaatatcccatcccacagcacgatttaaaaggattaaagcctgttatcacttgcctgttacagcatggccttttaaagcctataaactctccttacaattcccccattttaccttgtcaaaaacctgacaagtcttataggttagttcaggatctgtgccttagcaaccaaattgtcttgcctagccaccctgtggtgccaaacccatatactctatcctcaatacctccctccacaacccattattctgtcctagcaaacctagctgaccccatagatcctaattcctttcgccactcctctttccattccttaaaaacagccctagaagctgccaccacgctagctctccctaactcatcccaacccttttcattacacacagccaaagtactgggctctgcggtcaaaattcttacacaagagccggaaccgtgccctgtagcctttctgtccaaacaacttgaccttactattttaggctggccatcatgtctccgtgcagaggctgccgccgctctaatacttttagaggccctaaaaatcacaaactatgctcaactcactctctacagttctcataacttccaaaatctattttcttcctcccacctgatgcatatactttctgctccccggctccttcagctatactcactctttgggtctcccacaattaccactgtttctggcctggacttcaatctggcctcccacattattctggataccacacctgacccccatgactgtatctctctgatccacttgacattcactccatttccccatatttccttctttcctcttccccatcctgatcacactcagtttattgatggcagttccaccaggcctaatcgccactcaccaacaaaggcaggctatgctatagtatcttccacatctatcattgaggctaccgctctgcccctctccactacctctcagcaaggcgaactcatgccttaacctgagccctcactcttgcaaaaggactacgcatcaatatctatactgactcgaaatatgccttccatatcctgcaccaccgtgctgttatatgggctgaaagaggtttcctcaccgtgcaagggtcctccatcattaattcctctttaataaaaactcttctcaaggccgctttacttccaaaggaagctggagtcattcactgcaagcaagggccatcaaaaggtgtcagatctcatcgttcagggcaacgcttatgctgataaggtagctaaacaagcagctagcgttccaacttctgcccctcatggccagtttttctccttctcgtcagtcactcccacctactctgccactaaaacttccacctatcaatgtcttcctacacaaggcaaatggttcttggaccaaggaaaatatctccttccagcctcacaggcccattctattctgtcgtcatttcataacctcttccatgtaggttacaagccgctagcccatctcttaaaacctctcatttcctttccatcgtgaaaatctatccccaatccaccactcttgcctccctcttggagtggatagatgatctttgctgacagaacacactccaatactttcaccctgatgaagtcttattctttacttttatactcattcttattcttgttcccgttcttatgccacccactacctctccccagctatctctatcacactatcaatcgcactcactctctcctagccatttctaatccttctttaacaaacaattgctggctttgcatttcttttttctccaaaatcaccgaggccctgacttactcactgctaaaaaaaggggactccgtatatttttaaataaagagtgttgtttttctgtaaatcaatctggcctggtatatgacaacataataaaactcaaggatagagcccaaaaattcgccaaccaagcaagtaattatgctgaacccccttaggcactctctaattggatgtcctgggtcctcccaactctcagtcctttaatacctgtttttctccttcttttattcagaccttctaacttctgtttagtttctcaattcatacaaaactgtatccaggccatcaccaatcattctatatgacaaatgtttcttctaacaaccccacaatatcaccccttaccacaaaatcttccttcaacttaa

SEQ ID NO: 219 - DNA, 4992 bp, Homo sapiens
gtcaggcctctgagcccaagctaagccatcatatcccctgtgacctgcacatacacatccagatggccggttcctgccttaactgatgacattccaccacaaaagagatgaaaatggcctgttcctgccttaactgatgacattatcttgagaaattccttctcctggctcaaaagctcccctactgagcacctggtgaccccccactcctgcccactagagaacaacccccctttgactgtaattttcctttacctacccaaatcttataaaacggccccacgcctatctcccttcgctgactctcttttcagactcagcccgcctgcacccaagtgaaaaacagccttgttgctcacacaaagcctgtttggtggtctcttcacacagacgcgagtgaaattcggtgctatgactcggatcaggggacctcccttggaagatcaatcccctgtcctcctgctcttcttatcacttcccctcctcacacccagttgggcttacagtttcattccgtgactagccctccccaacctgcccagcaatttcctcttaaaatggtggctggagctaaaggcatagtcaaggttaatgctcctttttctttatccgacctctcccaaatgctcccagttagcatttaggctctttttcatcgaatatgaaaaacccagcccagttcatggctcatttggctgcaaccctgagacactttacagccctagaccctaaaaggtcaaaaggctgtcttattctcagtacacattttattacccaatccactcccgactttaaataaaactccaaaaattaaattccagccctcaaaccccacaacaggacttaattaacctcgccttcaaggtgtacaataatagaaaaaacttgcaattccttgcctccactgtgagacaaaccccagccacatctccagcacacaagaacttccaaatgcctaaaccgcagtggccaggcattcctccaggcccgcctcccccaggagcttgctacaagtgccagaaatctggccaccaggccaaggaacgcccgcagccgaggattcctcctaagctgcgtcccatctgtgcaggaccccactgaaaatcagactgttcaactcacctggcaaccactcccagagcccctggaactctggcccaaagctctctgactccttcccagatcttctcggcttagcagctgaagactgacaccgcccaattgcctcggaagcctacaggaccatcacagacgctctgggtaactctcacagtggaggataagtccgtccccttcttagtcaatacggaggctacccactccacattaccttcttttcaagggcctgtttcccttgtctccataactgctgtgggtattgacggccaggcttctaaacctcttaaaactccccaactctggtgccaacttagacaatactcttttaagcactccttttaattatccccacctgcccagttcccttattaggctgagacactttaactaaattatctgcttccctgactattcctgggctacagccactcctcattgccaccttttcccccagttcaaagccgccttcacatcctcctcttgtatccctccaccttgacccacaagtataggatacctctactccctccttggcgactgatcatccaccccttaccatctcattaaaacctaatcacccttaccccattcaacgccagtgtcccatcccgcagcacgctttaaaaagatcaaagcctgttatcactcacctgctacagcatggccttttaaagcctataaactctccttacaattcccccattttacctgtcctaaaaccagacaatccttacaagttagttcaggatctgcgccttatcaaccaaattgttttgcctttccaccccatggtgccaaacccatatactctcctatcctcagtacctccctctacaacccattatcctgttctggatctcacacatgctttctttactattcctttgcacccttcatacccagcctctcttcgctttcacttggactgaccctgacacccattaggctcagcaaattacctaggctgtactgccacaaggcttcacaaacagcccccattacttcagtcaagcccaaatttcatcctcatctgttacctatctcggcataattctcataaaaacacacgtgctctccctgctgattgtgtccgactaatctcccaaacctcaatcccttacaaaacaacaactcctttccttcctaagcatggttagtgcagtcagaattcttacacaagagccaggacaacaccctgtagcctttctgtccaaacaacttgaccttactgttttagcctagccctcaagtctgcatgcggtggccgccaccaccctaatacttgaaaaggcgcttaaaatcacaaactatgctcaactcactctctacagttctcataacttccaaaatctattttcttcctcacacctgacacatatactttctgctccccggctccttcagctgtactcactctttgttgagtcccacaattaccattgttcttggcctggacttcaatccggcctcccacattattctggataccacacctcatcctcatgactgtatctctctgatccagctgacattcaccccatttccccatatttccttatttcctgttcctcaccctgatcacatttagtttattgacggcagttccaccaggcctaatcgccactcaccagcaaaggcaggctatgctatagtatcttccacatctatcactgaggctaccgctctgcccccctccactacctctcagcaagccaaactagctgccttaactcaagccctcactcttgcaaaaggactacatgtcaatatttatactgactctaaatatgcctttcatattctgcaccaccatgctgttatacaggctgaaagagatttcctcactacacaagggtcctccatcattaatgcctcttaaataaaaactctgctcaaggctgctttacttccaaaggaagctggagtcattcactgcaaaggccatcaaaaggcgtcagatcccattgctctaagcaacgcttatgctgataaggcggctagacaagcagctagttctccaacttctgtccctcacggccagtttttctccttcccatcggtcactcccacctactcccccgctgaaacttccacctatcaatctcttcccacacaaagcaaatagttcttaaaccaaggaaaatatctccttccagcctcacaggcccattctattctgtcgtcatttcataacctcttccatgtaagttacgagccgctaacctgtctcttagaacctctcatttcctttccatcctagaaatctatcctcaaggaaatcacttctcagtgttccatttgctattctactacccctcagggattgttccagcctcctccctttcctacacatcaagctcagagatttgccccttcccaggactggcaaattgactttactcacatgccccgagtcagaaaactaaaatacctcttagtctaggtagacattttcactagataggtagaggcctttcctacagggtctgagaaggccaccgcagtcatttcttcccttctgtcagacataattactcagtttagccttcccacctctacgcagtccgatggtggactggcctttattagtcaaatcagcccagcagtttttcaggctcttggtattcagtgaaacctttatatcccttacagtcctcagtgttcaggaaaagtagaacagactaaaggtcttttaaaaacacacctcaccaagctcagccaccaacttaaaaaggaatggacaatacttttaccactttcccctctcagaattcaggcctgtcctcagaatgctacagggtacagcccatttgagctcctgtatagatgctcctttttattaggccccattctcattccagacaccagaccaacttggactgtgccccaaaaaacttgtcatccctactatcttctgtctagtcatactcctattcaccgttctcaactactcatacatgccctgctcttgtttacactgccagtttacaccatttctccaagtcatcacagctgatacctcctggtgctatccccaaactgccactcttaactcttaaagtaaataatctttgctggcaggactatgctgaatctccttaggcactctctaattaaatgtcctaggtcctcccaattcttagacctttaatacctgtttttctcctcctgttattccgtttagtttttcaattcatacaaaaccatatccaggccatcaccaataattctaaatgacaaatgtttcttctaacagtcccacaatatcaccccttgccacaaaatcttccttcaatttaatctctcccactctaggttcccacaccgccccaatcccgctggaagcagccctgagaaacatcgcccattatctctccataccaccccaaaaattttcgccgtcccaacactttaccactatttcattttatttttcttatgagtataagaagacaggaatgtcaggcctctgagcccaagctaagccatcatatcccctgtgacctgcacatacacatccagatggccggttcctgccttaactgatgacattccaccacaaaagaaatgaaaatggcctgttcctgccttaactgatgacattatcttgagaaattccttctcctggctcttcctggctcaaaagctcccctactgagcaccttgtgacccccactcatgcccaccagagaacaacccccctttgactataattttcctttacctacccaaatctgataaaacggccctacccctatctcccttcgctgactctcttttcggactcagcccgcctgcacccaggtgaaataaacagccttgttgctcacacaaagcctgtttggtggtctcttcacacggatgccagtgaaa

SEQ ID NO: 220 - DNA, 2205 bp, Homo sapiens
tgcggtcagaattcttacacaacagccaggaccgcaccctgtagcctttctgtccaaacaacttgaccttactgttttagcctagccctcatgtctgcgtgcagcggctgccactgctttaatacttttagaggccctaaaaatcacaaactatgctcaactcactccctacagctctcataatttccaaaatctattttcttcctcacacctgacgcatgtactttctgctccccggctccttcagctgtactcactctttattaagtcccacaattacccttgttcctggcccggacttcaatcccgcctcccacattattccagataccacacccgaccctcatgactgcatctctctgatccacctgatgttcatcccatttccccacatttccttcttcgctgtttctcaccctgatcacacttgatttattgatggcagttccaccatgcctaatcgccacacaccagcaaaggcaggctatgctatagtacaagccactagcccgcctcttagaacctctcatttcctttccatcgtggaaatctatcctcaaagaagtaacttctcagtgttccatctgctactctactactcctcagggattattcagggcccctcccttccctacacatcaagctcaaggatttgcccccacccaggactggcaaattagctttactcaacatgcccctagtcagataactaaaatacctcttagtctaggtagacactttcactagataggtacaggcctttcctacagggtctgagaaggccaccacagtcatttcttccattctgtcagacataattcctcagtttagccttgtcatttcttcccttctgtggacataattcctcagtttagcctccccacctctatacagtctgataaccagcctttattagtcaaatcaggcaagcagtttttcaggctcttagtattcagtgaaacctttatatcccttacagtcctatgtcttcaggaaaagtagaacagactaaaggtcttttaaaaacacacctcaccaagctcagccaccaacttaaaaaggactggacaacacttttaccactttcccttctcagaagtcagacctgtcctcagaatgctacaaagtacagcccatttaagctcctgtatagatgctcctttttattaggccccagtctcattccagacaccagaccaacttagactgtgccccagaaaaacttgtcatccctactgtcttctgtctagtcatacttctattcaccattctcaactactcatacatgccctgctcttgtttacactgccggtttacactgtttctccaagccatcacagctgatatctcctggtgctatctccaaactgccactcttaactcttgaagtaaataaataatctttgctggcaagactatgctgaatctccttaggcactctctaatcagatgtcctgtgtcgtcccaattcttagaccttttatacctgtttttctccttctcttattccatttagtttttcaattcatacaaaactgtatccaggccatcaccaataattctaaatgacaaatgtttcttctaacaaccccacaatgtcaccccttaccacaaaatcttccttcagcttaatctctcccactctaggttcccacgccacccctaatcccgctcgaagcagccctgagaaacgtcgcccattatctctccacaccatcccccaaaattttcaccgtcccaacactttaccactattttgttttatttttcttattaatataagaagacaggaatgtcaggcctctgagcccaagctaagccatcatatcccctgtgacctgcatgtacacatccagatggccgcttcctgccttaattgatggcattccaccacaaaagaagtgaaaatggcctgttcctgccttaactgatgatattatcttgtgaaattccttctcctggctcatcccggctcaaaagctcccccactgagtacactgtgacccccactcctgcacaccagaaaacaaaccccctttgactgtaattttcctttacctacccaaatcttataaaacggccccacccctatctccctttgctgcctcttttcggactcagcccacctgcccccaggtgaaataaacagctttattgctcacacaaagcctgtttggtggtctcttcacacagacgcgcatgaaa

SEQ ID NO: 221 - DNA, 84 bp, Homo sapiens
tgccccttttcagcaggaagtagccagaaagaatcgtcgtccaacaccccaacagcagttaggtttacttctcttcagggagga

SEQ ID NO: 222 - DNA, 780 bp, Homo sapiens
gagagacaggactagctggatttcctaggccaactaagaatccctaagcctagctgggaaggtgaccgcatccatctttaaacacggggcttgcaacttagctcacacctcaccaatcaggtagtaaagcgagctcactaaaatgctaattaggcaaaaacaggaggtaaagaaatagccaatcatctattgcctgaaagcacagcaggaggaataatgatcgggatataaatccaggcattcgagccagcaacggctaccctctttgggtcccctccctttgtatgggagctctgttttcactctattaaatcttgcaactgcactctcttctggtccatgtttattatggctcaagctgagctttcgctcaccgtccaccactgctgtttgccgccgtcgcagacctgccactgacttccatccctccagatccagcagggtgtccgctgtgctcctgatccagcgaggtgcccattgccactcccgattgggctagaggcttgccattgttcctgcagggctaagtgcctgggttcgtcctaatcgagctgaacactagtcactgggttccatggttctcttccgtgacccatggcttctaatagagctataacactcaccacatggctcaagattccattccttggaatctgtgaggccaagaaccccaggtcagagaacacgaggcttgtcaccatcttggaagtggcccaccaccattttggaagtggcctgccaccatcttgggggctctgggagcaaggacccccggtaaca

SEQ ID NO: 223 - DNA, 6342 bp, Homo sapiens
gtcaggcctctgagcccaagctaagccatcatatctcctgtgacctgcacgtacacatccagatggctggttcctgccttaactgatgacattccaccacaaaagaaatgaaaatggcctgttcttgccttaactgatgacattatcttgtgaaattccttctcctggctcatcctggctcaaaagctcccctactgagcaccttgtgacccccactcctgccagagaacaacccccctttgactgtaattttcctttacctacccaaatcttacaaaacggccccaccccatcttccttcactgactctcttttcagactcagcccgcctgcacccaggtgaaataaacagccttgctgctcacacaaagcctgcttgttggtctctttacacagatgcgcatgaaatttggtgctgtgactcggatcggggggacctcccttgggagatcaatcccctgtcctcctgctctttgctccgtgaaaaagatccacctacgacctcgggtcctcagacccaccagcccaaggaacatctcaccaattttaaatcaggtaagccgcctcttcttaatctcttctccaacctctctcactatccctcaaccactttctcctttcaatcttggtaccacccttcaatctctcccttctcttaagttcagttcctttccttttctggtagagacaggagacgcgttttatccgtggacccaaaactccggcgctggtcacagactagggaagacagtcttcccttggtgtttaatcacgtggggacgactgcctgattactcacccacgtttcagaggtgtctgaccacacggggacgcctgccttggtccttcacccttagcagcaagtactgcttttctggggggcaagaacctcccaactccttctctctgtgtctctaccccttctctgctttttcaggggggcaagaaccccccaaccccttctccttcacccttagtggcaagtaccacttttctagggggcaagaaccccctgatcccttatttccatgccccaacctcttatctctgtgccccgatcccttaattccatgccctgacctcttatctttgcaccccaatcccttatttccatgccctgacttcttatctctgcaccccatcccttatttccacgccccaacctcttatctctgcgccctgatcccttatttctgtgccctgacctcttatctctgcaccccaaccccttatatctccatgccccgacccctttcctgcttttctggaaggtaagaacccccaaaccccttccctccgtgtctctactctgttctctgggcttgcttccttcactatgggcaaccttccaccctccattcctccttcttctcccttagcctgtgttctcaagaacttaaaacctcttcaactcacacttgacctaaaacctaaacaacttattttcttctacaatgccgcttgaccccaatacaaactcaacagtggttccaaatagacagaaaacggcactttcgatttttccatcctacaagatctagataattcttgttgtaaaataggcaaatggtctgaggtgcctgacgtccaggcattcttctacacgttgttccctccctagtctctgttcccaatgtgattcctccccaatcctccttctttccctcctggctgtcccctcagtcccaaccccaagcgtcgctgagtctttccagtcttccttttctacagacccatctgacctttcccctcctccccaggctgcttgtcgccaggccgagctaagtcccaattcttcctcagcctcagctcctccaccctataatccttctatcatctcccctcctcacacccagtctggcttacagttttgttccgcgactagccctcccctacctgcccagcaatttcctcttaggaaagtggctggagctaaaggcatagtcaaggttaatgctcctttttctttatccgacctctcccaaatcagttagcctttaggctctttttcatcaaatatgaaaaacccagcccagttcatggctcgtttggcagcaaccctgagacgctttacagccctagaccctaaaaggtcaaaaggccatcttattctcaatatacatttgattacccagtcagctcctgactttaaataaagctccaaaaattaaattccggccctgaaaccccacaacaggacttaattaacctcgccttcaaggtgtacaataatagaaaaaagttgcaattccttgcctccactgtgagacatatcccagccacatcaccagcacacaagaacttccaaacacctgaaccacagcagccaggagttcctccagaacctcctccccaagaagcttgctacaagtgccggacatctggccaccgggacaaggaatgcccgcagcccaggattcctcctaagccgtgtcccatctgtgtaggaccccactgaaaatcagactgttcaactcacctggcagccactcccagagcccctagaactctggcccaaggctctctgagtgactccttcccagatcttctcggcttagcagctgaagactgacactgcccgatcgcctcggaagccccctaaaccatcacggacgccgagcttcaggtaactctcacagtggaaggtaagtccgtccccttcttaatcgatatggaagctacccactccacattaccttcttttcaagggcctgtttcccttgcctccataactgttgcaggtactgacggccaggcttctaaacctcttaaaactccccaactctggtgccaacttagacaatactcttttaagcactcctttttagttatccccacctgcccagttcccttattaggccgacactttaactaaattatctgcttccctgactattcctgggctacagccacacctcatcgctgccttttcccccagttcaaagcctccttcacatcctccccttgtatctccccatcttaacccacaagtataagacacccctactccctccttagtgaccgatcctgcaccccttaccatcccattaaaacctaatcacccttaccctgctcaatgtcaatatcccatcccacagcacgcttcaaaaggattaaagcctgctattactcgcctgctacagcatggccttttaaagcctataaactccccttacaattcccccattttacctgtcctaaaaccagacaaggcttacaggttagttcaggatctgcgccttatcaaccaaattgttttgcctatctaccccgtggtgccaaacccatatactctcctatcctcaatacctccctccacaacccattattctgttctagatctcaaacatgctttgtttgctattcctttgcacccttcatcccagcctctcttcgctttcacttgtactgaccctgacacccatcaggctcagcaaattacttaggctgtactgctgcaaggcttcacagacagcccccattacttcagtcaagcccaaatttcttcctcatctgttacctatctcagcataattctcataaaaacacacgtgctctccctgattatcgtctccggctaatctcccaaaccccaatcccttctacaaaacaacaactcctttccttcctaggcatggttagtaaggtcagaattcttacacaagagctgggaccacgtcctatagcctttctgtccaaacaactggaccttactgttttaacccaaccctcatgtctgcatgcagcggctgccgctgccttaatacttttaaaggccctaaaaatcacaaagtatgctcaactgactctctacagttctcataacttccaaaatctattttcttcctcatacctgatgcatatactctctgctccctggctccttcagctatattcactctttgttgagtctcccacaattaccattgttcctggcacggacttcaacccggcctcccacattattctggataccacacctgaccctcatgactgtatctctctgatccacctgacattcaccccatttccccgtatttccttctttcctgttcctcaccctaatcacatttggtttattgatggcagttccaccaggcctaaatgccactcaccagcaaaggcaggctatgctatagtatcttccacatctatcattgaggctaccgctctgcccccctccactacctctcagcaagccgaactagttgccttaacccaagccctcactcttgcaaaaggactatgcgtcaatatttatactgactctaaatatgcctttcatatcgtgcaccaccatgcaagaagtttcctcactaaacaagggtcctctatcattaatccctctttaataaaaacgcttctcaacgccgcttaacttccaaaggaagctagagtcattcactgcaaggggcatcaaaaggcatcagatcccattgctctaggcgacgcttacgctgattaggtggctagacaagcagctagcattccaacttctgtccctcacagccagtttttctccttcacgtcagtcactcccacctactcccccactgaaacttccacctatcaatctcttcccacagaaggcaaatggttcttagaccaaggaaaatatctccttccagcctcacaggcccattctattctgtcgtcatttcataacctcttccatgtaggttacaagccgctagcccgtctcttagaacctctcatttcctttccatcctggaaatctatcctcaaagaaatcacttctcagtgttccatttgctattctactacccctcagggattgttcaggcctcctccctttcctacatatcaagctcggagatttgcccctgcccaggactggcaagttgactttactcacgtgccccgagtcagaaaactaaaatacctcttagtctaggtagacgctttcactggatgggtagaggcctttcctacagggtctgagaaggccaccgcggtcattttttcccttctgttagacataattcctcggtttggccttcccacctctatacagtctgatagcagaccggcctttattagtcaaatcagccaagcattttttcaggctcttggtattcagtgaaacctttatttcccttacggtcctcagtcttcaggaaaggtagaatggactaacggtcttttaaaaacacacctcaccaagctcagccaccaacttaaaaaggactagacaatacttttaccactttcccttctcagaattcaggcctgtcctcagaatgttacaaggtacagctcatttaagctcctgtatagatgctcctttttattaggccccagtatcattccaagaccaacttggactgtgccccaaaaaacttgtcatccctactatcttctgtctaatcatactcctattcactgttctcaactactcacacatgccctgctcttgtttacactgctggtttacactgtttctccaagccatcacagctgatatctcctggagctatccccaaactgccactcttaactcttgaagtaaataaataatctttgctggcagaactatgctgaacctccttaggcactctctaattaaatgtcctaggtcctcccaattcttagtcctttaatacctgtttttctccttctcttattccatttagtttttcaattcatacaaaaccgtatctaggccatcaccagtaattctaaatgacgaacgtttctcctaacagtcccacaatatcaccccttaccacaaaatcttccttcagcttaatctctcccattctaggttcccacaccgcccctaattccgctcgaagcagccctaagaaacatcgcccattatctctccgtaccatcccccaaaattttcgctgtcccaacacttcaccactattttgttttatttttcttattaatataagaagacaggaatgtcaggcctctgagcccaagctaagccatcatatctcctgtgacctacacgtacacatccagatggccggttcctgccttaactgatgacattccaccacaaaagaaatgaaaatggcctattcttgccttaactgatgacattatcttgtgaaattccttctcctggctcatcctggctcaaaagctcccctactgagcaccttgtgacccccactcctgcccgccagagaacaacccccctttgactgtaattttcctttacctacccaaatcttataaaacagctccaccccatcttccttcactgactcttttcagactcagcccgcctgcacccaggtgaaataaatagccttgttgctcacacaaagcctgtttggtggtctctttacacagacgtgcatgaaa

SEQ ID NO: 224 - DNA, 325 bp, Homo sapiens
gagagacaggactggctggatttcataggccaactaagaatccctaagcttagctgggaaggtgaccacatccacctttaaacatggggcttgcaacttacctcacacccgaccaatcaggtaggaaagagagctcactaaaatgctaattaggcaaaaacaggaggtaaagaaatagccaatcatctatcgcctgagagcacagtgggaggggcaatgatcaggatataaactcaggcattcaagcctgcaaaggctaccttctttgggtcccctccctttgtatgggagctctgttttcactctattaaatcttgcaactgca

SEQ ID NO: 225 - DNA, 440 bp, Homo sapiens
gtcaggcctctgagcccaagctaagccatcatatcccctgtgacctgcacgtatatgcccagatggcctgaagcaagtgaagaatcataaaagaaatgaaaatggcctgttcctgccttaactgatgacattctaccacaaaagaagtgaaaatggcctgttcctgccttaattgatgacattactttgtgaaattccttctcctggctcatcctggctcaaaagctcccctgctgagcatcttgtgacccccacccctgcccaccagagaacaacccccctttgactgtaattttcctttacctacccaaataaatgtccccacccctatctcctttcactctttttggactcagcccacctacacccaggtgaaataaacagccttgttgctcacacaaagcctgtttggtagtctcttcacaccgacaggagtgaaa

SEQ ID NO: 226 - DNA, 5749 bp, Homo sapiens
gtcaggcctctgagcccaagctaagccatcgtatcccctgtgacctgcacgtacacatccagatggccagttcctgccttaactgatgacattatcttgtgaaatgccttctcctggctcatcctggctcagaagctcccctactgagcaccttgtgacccccactcctgcctgccagagaacccccctttttcctttacctacccaaatcctataaaatggccccaccccatctcccttcgctcactcttttcagactcagtccacctgcacccaggtgaaataaacagctttattgttcacacaaagcctgtttggtggtctcttcacacggacccatgtgaaatttggtgtcataactcggatcgggggacctaccttgggacatcaatcccctgtcctcctgctctttgctctgtgagaaagatccacctacaacctcaagtcctcaggctgaccagcccaagaacatctcaccaatttccaatccggtaagcagcttctttttactctcttctccaacctccctcactatccctcaacctctttctcctttcaatcttgatgccacacttcaatctctcccttctcttaatttcaattcctttcattttctggtagagacaaaggagacacattttatccgtggacccaaaactctggcgcctgtcacggactagggaaggcagcttttccttggtgtttaatcattgcagggacacctctgtgattattcacccaggtttcagaggtgtcagaccacgcagggatgcctgcctttgtccttcacccttagtggcaagtcccacttttctgggggaaggggcaagaacccctcaaccccttctccttcacccttagcagcaagtcccacttttctgggggaggggaaggaaccccctcttatctcagtgccccgatcccttatttctgtgccccaacctcttatctctgtggcccgatcccttatttccatgccccaacctcttatctctgtgacccaatcccttatttccacgacctgacctcttatctctgcaccccaaccccttatttctgtgccctgacctcttagctctgcatcacaaccctttatttctgcacactgacccctttcccacttttcgggaaggcaagaaccccccaccccttctctctgtgtctctactctctcttttctctaggcttgcctccttcactatgggcaagcttctgccctccattcccccttcttctcccctagcctgtgttaaaaacctaaaatcttttcaactcacacctgacctaaaacctaaatgccttattttcttccacaatgccacttgaccccaatacaaactcaacagtagttccaaatagccagaaaatggcactttcaatttttccaacctacaagatctagataattcttgtcgtaaaatgggcaaacggtctgaggtgactgatgcccaggcattcttttacacatcggtccctccctagtctgttcccagtgcaactcatcccaaatcttccttctttccctcccacctgtcccctcagtcccaaccccaagcgtcactgagtctttgtaatcttccttttctacagaccaatctgacctctcccctcctcaccaggccaagctaggccccaattcttcctcagcctccgctcctccaccctataatccttttatcacctcccctcctcacaccgggtccagcttacagtttcgttccatgactagccctccccaacctgcccagcaatttcctctgaaaaaggtggctggagctaaaggcatagtcaaggttaatgctcctttttctttatcccaaatcagatagggtttaggctctttttcatcaaatataaaaatccagcccagttcatggctcatttggcagcaaccctgagatgctttacagccctagaccctaaaaggtcaaaaggccgtcttattctcaatatacattgtattacccaatctgctcccaatattaaataaaactctgaaaattaaattccggccctcaaaccccacaacaggacttaattaacctcgccttcaaggtgtacaataatagagtagaggcagcaaagtagcaacatatttctgagttgtaattccttgcctccactgtgagacaaaccccagccacatctccagcacacaagaacttccaaacgcctaaagtgcagtggccaggtgttcctccagaaccgcctcccccaggagcttgctactagtgccagaaatctggccaaagaatgcccacaacccgggattcctcctaagccatgtcccatctgtgtgggaccccactagaaattggactgttcaactcacctgacagccactcccagagcccctggaactctggcccaaggctctctgactgactccttcccagatcttcttggcttagcagctgaagactgacactgcctgatcgatcacttcggaagcctacaggaccatcacagatgctctaggtaactctcacagtggagggtaagtccgtccccttcttaatcaatatggaggctacccactccacattaccttcttttcaagggcctgtttcccttgcctccataactgttgtggttattgacagccaggcttctaaacctcttaaaactccccaactctggtgccaacttagacaatactcttttaagcactcctttttagttatccccacctgcccagttcccttattaggctgagacactttaactaaattatctgcttccctgactattcctggactatagctacatctcattgccacccaccttaacccacaagtagaagatacctctactccctccttggcgaccgatcatgcaccccttaccatctcattaaaacctaatcacccttaccccgctcaatgccaatatcccatcccacagcatgctttgaaaggattaaagcctgttatcacttgcctgctacagcatagccttttaaagcctataaactctccttacaattcccccattttacctgtcctaaaaccatccaccccatggtgccaaatgcatatactctcctatcctcaattcctccctccacaacccattattctgttctggatctcaaacatgctttctttactattcctttgcacccttcatcccagcctctctttgctttcacttggactgaccctgacacccatcaggctcagcaaattacctgggctgtactgccgcagagcttcacagacagcccctattacttcagtcaaggccaaatttcttccttatctattacctatctcagcataattctcataaaaacacacatgctctccctgccgatcgtgtccaactaatctctcaaaccccaaccccagctacaaaacaacaactcctttccttcctgggcatggttggatacttttgcctttagatacctggtattgccaccctaacaaaaccattatataaactcaaaaaaggaaacctagcttactccatagatcctaaatcctttccccactcctctttcagttccttgaagacagctttaaagactgcccctaccctagctctccctgactcatcccaacccttttcattacacacagccaaagtgcagcgctgtgcagtcgaaattcttacacaaggaccaggattgcttcctgtagcctttttgtccaaacaacttgaccttactgttttaggctggccattatgtctctgtgcagtggctgctgctgccctaatacttttagaggtcgttaaaatcacaaactatgctcaactcactctctacagctctcataatttccaaaatctattttcttcctcacacctgacgcatatactttctgctccctggctccttcagctgtactcactctttgttgagtctcccacaattaccattgttcctggcccggacttcaatccagcctctcacattattcctgataccacacctgaccctcatgactgtatctctctgatccacctgacattcaccccatttccccacatttccttctttcctgcttctcaccctgatcacacttagtttattgatggcagttccaccaggcctaattgccacacaccagcaaaggcaggctatcctatagtacaagccactagcccgcctcttagaacctctcatttcctttccagcgtggaaatctatcctcaaagaaataacttctcagtgttccatctgctattcttttactcctcagggattattcaggccccctcccttccctacacatcaagctcagggatttgcccccactcaggactggcaaattagctttactcaacgtgccctgagtcaggaaactaaaatacctcttggtctaggtagacactttcactggataggtagaggcctttcccacagggcctaagaaagccaccacggtcatttcttcccttctgtcagacataattcctcagtttggccttcccacctctatacaatccaatagtagaccggcctttattagtcaaatcagccaagcagtttttcaggctcttagtattcagtgaaacctttatatcccttacagtcctcagtcttcaggaaaggtagaacagactaatggtcttttaaaaacacacctcaccaatctcagccaccaacttaaaaaggactggacaatacttttaccactttcccttctcagaattcaagcctgtccttggaatgctacaaggtacagcccatttaagctcctgtatagatgctcctttttattaggccccagtctcattccagacaccacaccaacttggaatgtgccccaaaaaacttgtcatccctactatcttctctctagtcatactcctattcaccgttctcaactactcatacatgccctgctcttgtttacactgccagtttacactgtttctccaagccatcgcagctgatagctcctggtgctatgcccaaaccgccactcttaactcttaaataatctttgctggcaaggctatgctgaacctccttaggcactctctaattagatgtcctaggtcctcccaattcttagtcctttaatacctgcttttctccttctcttattctgtttagtttttaattcatacaaaactgtatccaagccatcatcaataattctaaatgacaaatgtttcttctaacaaccccacaatatcaccccttaccacaaaatattccttcagcttcatctctcccactctaggttccaacgctgcctctaatcccgctcaaagcagccctgagaaacatcgcccattacttctccataccatccccaaaaattttcgccgtcccaacactttaccactatttcgttttatttttcctgttaatataagaagacaggaacgtcaggcctctgagcccaagctaagccatcatatcccctgtgacctgcacgtacacatccagatggccggttcctgccttaactgatgacattccaccacaaaataaatgaaaatggcctgttcctgccttaactgatgacattatcttgtgaaattccttctcctggctcatcctggctcaaaagctcccctactgagcaccttgtgacccccaccactcctgcctgccagagaacaacccctttttcctttacctacccaaatcctataaaacagccccacccctatctcccttcactgactctctttttggactcagcctgcctgcaccctggtgaaataaacagctttattgctcacacaaagcctgtttggtggtctcttcacacggatgcacgtgaaa

SEQ ID NO: 227 - DNA, 1097 bp, Homo sapiens
cccggaacagggggattcctttgggagaccagtcccctgtccttgccctcactccatgaggagatccacctatgacctccagtcctcagacaagccccaggaacatctcaccaatttcaaattgggtaagtggtctcttcactctcttctccagcctctcttgctacccttcaatctccttgtccttccaattccagttctttttcctctctagtagagacaaaggagacacattttatctgtgaattcagaaaccccgacgtcggtcacagatttgggaagacagtcgtcccttggtgtctgatcttcacagggacacctgccttgatcattcacccacactcccctcgtggcaagccaattatggggatgcctgctttggctgatcacccacattacagcccaggactcagccagggacacctaatgaaagcctggtagctgctcacttccccttctctacatctctacctttctcttcaatttcacctccttcactatgggcaactttacaccctccattcctccctcttcccccttagcctgtgtacttaaaaacttaaaacctcttaaactaacacctgatctaaaacccaaaagtcttattttcttctgcaatgccgcttggccccaatataaacttgacaatggttccaaatggccagaaaatgtaactttcgatttctccatcctacaaaacctagataatttttgtgaaaaattgggcaaattgtctgaggtgccttacgtccaaacattttttacacttcgctccctccctagtctctgctcccagtgcgacttgtctcagattttccttctttctctcccgtctgctccttcagtctccaccccaagctcagagtcctctgaatcctccttttccactgacccttctgacctctctcctcctcccccggccgctcctcgccaggctgaatcgggtcccaattcttccgcagcctctgctcccccaccctataaccctgctattaccccccctcctcacactcagtcttgcttacagtttcattccccgactagctctcccccacctgcccaacaatttcctcctagagaggtggctggagctaaag

SEQ ID NO: 228 - DNA, 138 bp, Homo sapiens
gaggaaacagaggttttgtctgacccccctcctccaatagacaggaaaaaagacaacgaatacgctacagctatgggaccttgtcttaggcaagtgacattagaaggggagctcttagcctgccaggtaatgcaagat

SEQ ID NO: 229 - DNA, 5666 bp, Homo sapiens
gtcaggcctctgagcccaagccaagccatcgcatcccctgtgacttgcacatatacgcccaatggcctgaagtaactgaagaatcacaaaagaagtgaaaaggccctgccctgccttaactgatgacattccaccattgtgatttgttcctgccccaccttaactgagtgattaacactgtgaatttcctactcctggctcagaagctcccctactgagcaccttgtgacccctgcccctgcccaccagagaacaaccccctttgactgtaattttccattaccttcccaaatcctataaaacggccccacccttatctcccttcgcggactctcttttcggactcagcccacctgcacccaggtgaaataaacagctttattgctcacacaaagcctgtttggtggtctcttcacacggacacgcatgaaatttggtgccatgactcggatcgggggacctcccttgggagatcaatcctccgtcctcctgctctttgctccatgagaaagatccacctacgacctcaggtcctcagaccgaccagcccaagaaacatctcaccaatttcaaatccagtaagcggcctctttttactctcttctccaaccttcctcactatccctcaacctctttctcctttcaatcttggcgccacacttcaatctctcccttctcttaatttcaattcctttcattttcccatagagacaaaggagacacgttttatctgtggacccaaaactccggcgccggtcacggactgggaaggcaaccttcccttagtgtttaatcattgcagggacgcttttctgattattcacccacgtttcaaaggtgtcagaccatgcagggacgcctgccttggtccttcacccttagcagcaagtcccacttttctggggaaggggcaagtacctcaaccccttctctccttgtctctaccccttctctgcttttctggggaagaggcaagtaccccaaccccttctctccttgtctctaccccttctctgcttttctggggaaatggcaagtacctcaaccccttctctccttgtctctaccccttctctgcttttctggggaagaggcaagtaccccaaccccttctctccttgtctctaccccttctctgcttttctggggaaggagcaagtaccccaaccccttctctcctggtctctaccccttctctgcttttctggggaaggggcaagtaccccaaccccttctctccttgtctctaccccttctctgcttttctggggaaggggcaagtaccccaaccccttctctcctggtctctaccccttctctgcttttctggggaaggggcaagtaccccaaccccttctctccttgtctctaccccttctctgcttttctaggagaggggcaagtacccctcaaccccttctccttcacccttagtggcaagtccagctttcctggggcagggggaagtacccctcaaccccttctccttcacccttagcgccaagtcccgcttttctgggggaggggcaagtacctctcaaccccttctccttcacccttagcgacaagtcctgcttttctagggggcaagaacccccaatcccttatttccacaccctaacctcttatctgtgccccaatcccttatttccataccccaacctcttatctctgtgccccaatcccttatttccgtgccccaaccccccttcccacttttcaggagggtaagaacccccgaaccccttccctctatgtctctatgctctcttttctctgggtttgcctccttcactatgggcaaccttccaccctccattcctccttcttctcccttagcctttgttctcaaaaacttaaaacctcttcaactcacacctgacctaaaacctaaattccttttcttctgcaatgccacttgaccccaatacaaacttgacagtagttccaaatagccagaaaatggcactttgaatttttccatcctgcaagatctaaataattcttgttgtgaaataggcaaatggtctgaggtgcctgacgtccaggcattcttttacacatcagtcccttcctagtctctgtgcccagtgcaactcatcccaaatcttccttctttccctcctgcctgtcccctcagtgccaaccccaagcttcgctgagtctttctaatcttccttttctacagacccatctgacctctcccttcctccccaggctgctcctctccagaccaagctaggtcccaattcttcctcagcctctgctcctccaccctacaatctttttatcacctcccctcatcacacctggtccagcttacagtttcgttccatgactagccttcccccacctgcccagcaatttactcttaaaaaggtggctggagccaaaggcatagtcaaggttaatgctcctttttctttatcccaaatcagaagcgtttaggctctttttcatcaaatataaaaatccagcccagttcatggctcgtttggcagcaaccctgagatgctttacagccctagaccctaaaaagtcaaaaggccgtcttattctcaatatacattttattacccaatctgctcccgacattaaataaaactccaaaaattggaatctggccctcaaaccccacaacaggacttaattaacctcaccttcaaggtgtacaataacagaaaaaagttgcaattccttgcctccactgtgagacaaacaccagccacatctccagcacacaagaacttccaaatgcctgaaccccagcagccaggccttcctccagaacctcctcccccaggagcttgctacacgtgccggaaatctggccactgggccaaggaatgcctgcagcccgggattcctcctaagccgcatcccatctgtgtgggaccccactgaaaattggactgttcaactcacctggcagccactcccagagcccttggaactctggcccaaggctctctgactgactccttcccagatcttctcagcttagcagctgaagactgatactgcccaattgcctcagaagccccctagaccatcatggacaccaagcttcaggtaactctcacagtggaaggtaagcccgtccccttcttaatcaatatggaggctacccactccacattaccttcttttcaagggcctgtttcccttgcctccataactgttgtgggtattgacggccaggcttctaaacctcttaaaactccccaactctggtgccaacttagacaatactcttttaagcactcctttttagttatccccacctgcccagttccgttattaggctgagacactttaactaaattatctgcttccctgactattcctggactacagctatatctcattgccgcccttcttcccaatccaaagcctcctttgcgtcctcctcttgtatcccctcaccttaacccacaagtataagatacctctactccctccttggtgaccgatcatgcaccccttaccatctcattaaaacctaatcacccttaccccactcaacgccaatatcccatcccgcagcactctttaaaaagattaaagcctgttatcactcgcctgctacagcatggccttttaaagcctataaacgctccttacaattcccccattttacctgtcctaaaaccagacaagccttacaggatctgcgccttatcaaccaaattgttttgcctatccaccccgtggtgccaaacccatatactctcctatcctcaatacctgcctctacaacccattatcgtgttctagatctcaaacatgctttctttactattcctttgcacccttcatcccagcctgtcttcgctttcacttggactgaccctgacacccatcaagctcagcaaattacttaggctgtactgccgcaaagcttcacagacagcccccattacttcaatcaagcccaaatttcttcctcatctgttacctatctcggcataattctcataaaaacacacgtgctctccctgccaatcttgtccgactgatctctcaaaccccagcaccttctacaacacaacaactcctttccttcctaggcatggttagtgcggtcagaattcttacacaagagccaggaccacaccctgtagcctttctgtccaaacaacttgaccttactgttttagcctagccctcatgtctgcgtgcagcggctgccgctgctttaatactgttagaggccctaaaaatcacaaactatgctcaaatcactctctacatttctcataacttccaaaatctattttcttcctcatacctgatgcatatactttctgctccccagctccttcagctgtactcactctttaagtcccacaattaccattgttcctggcccagacttcaatccggcctctcacattattcctgataccacacctgacccccatgactgtatctctctgatccacctgatattcaccccatttccccatatttccttctttcctgttcctcaccctgatcacacttgatttattgatggcagttccaccaggcctaatcgccacacaccagcaaagacaggctatgctatagtacaagccactagcctgcctctcagaacctctcatttcctttccatcctggaaatctatcctcaaggaaataacttctcagtgttccatctgctattctactactcctcagggattattcaggccccctcccttccctactcatcaagctcgaggatttgcccccacccaggactggcaaattagctttactcaacatgcccgagtcaggaaagtaaaatacctcttagtctaaatagacactttcagtgaataagtaaaggcctttcctacagggtctgagaaggccaccgcagtcatttcttcccttctgtcagtcataattcctcagtttagccttcccacctctatacagtctgacaacagaccagcctttattagtcaaatcagccaagcagtttttcaggctcttagtattcagtgaaacctttatatcccttacggtcctccgtcttcaagaaaagtagaacggactaaaggtctttaaaaaacacaactcaccaagctcagccaccaacttaaaaaggactggacaatacttttaccactttcacttctcagaattcaggcctgtcctcagaatgttacaaggtacagcccatttgagctcctgtatagatgctcctttttattaggccccagtctcattcgacaccagaccaacttagactgtgccccaaaaaaacttgtcatccctactatcttttgtctagtcatactcctattcaccgttctcaactactcatacatgccctgctcttgtttacactgccggtttatactgtttctccaagccatcacagctgatatctcctggtgctatccccaaactgccactctaaactcttgaagtaaataaataatctttgctggcaggactatgctgaatctccttaggcactctctaatcagatgtcctaggtcctcccaattcttagaccttttatacctgtttttctccttctcttattccatttagtttttcaattcatacaaaaccgtatccaggccatcaccaatcattctatacgacaaatgtttcttctagcaaccccacaatatcaccccttaccacaagatcttccttcagcttaa

SEQ ID NO: 230 - DNA, 1747 bp, Homo sapiens
gtcaggcctctgagcccaagctaagccatcataacccctgtgacctgcacgtatacatctagagggcctggagcaactgaagaaccacaaaagatgacattccatcattgtgatttgctcctgccccaccccaactaatccatcaaccttgtgacattcctcccctagacaatgagtctcatgatctccccaccctgcaccttgtgatccccatccctgcccacaagagataaccacctttaactgtaattttccactacctacccaaatcctataaaactgctgtacccctatctccctttgctgactctcttttcagattcagcccagttgcacccaagtaaaataaacagtcttgttgctcacacaaagcctgttggtggactctcttcatatggactcatgtgacatttggtgccgaagacctgagacaggaggactcctttgggagaccggtcccctgtcctcgccctctctccatgagatccacccatgacctcgggtcctcagcccagccgaaggaacttctcaccaattttaaatcgggtaagtagcctcttttcattctcttctccaacctctcttgctagatatccctccactctttaatctctccctcccttaattttggttcctttccgtttctggtagagacagaggagacacgttttgtccatgaactcaaaattctgctgctggtcacagactcgggaagacagtcttcccttggtgtctaatcactgtggggatgcatgtctgattattcacccacattccagaggtgtctgaccactgcagggacgcctgccttgatccttcaccttggtggcaagtaccacctcccctggatggcaagtaccaacccccctctccatgtctctaccctctcttttctctaaacttacctttttactatgggcaaccttccaccctccattcctccttcttctcccttagcctgtgttctaaaaaacttaaaacctcttcaactctcacctgacccaaaacctaagcatcttattttcttctgcaacagcatttgaccccaatacaaacttaacaattgttctaaatggccagaaaatggcactttcgatttccccatcctacaagatctagataattttgtcaaaaaatgggcaaatggtctgaggtgcctgatgtccaggcatccttttacacatcagttcctccctagtctctgctcccaatgtgactcattccagatctttcttctttctctcctgtctgttccttcagtctccaccccaagctctgagtcctttaaatcttctttttctgtgaactcatccgacctctcccctcctccccacactgctcctcaccaggccaagcgaggtcccagttcttcctcagcttccactctcccaccctataatccttctatcgcctcccccactcacaaccggtccagcttacagttttgttccgtgactagccctccccaacctgcccaacaatttcctcttagagaggtggctggagctgaaggcagagtcaaggttaatgatcctttacatcttaacaaaattatccactaccctgactattcctggactacagccacatctcagtgccgcccttctccccaacctaaagcctccttcacgtcttcctcttgtatcccccaaccttaacccacaagtatgggacacttttactccctccctggcaaccaatcacacgcccgttactatcccattaaaacctaatcatccttaccccg

SEQ ID NO: 231 - DNA, 9634 bp, Homo sapiens
atagggaaaagaaagagcgatcagactgttactgtgtctatctagaaaaagtaagacaaaagaaactccattttgatctgtactaagaaaaattgttctgctttgagatgctgttaatctgtaactcttgtcccaaccctgtgctcacaaaaacatgtgctgtattgactcaagttttaagggatttagggctgtgcaggatgtgctttgttaaaaatgtttttgcagccaggcgcagtggctcatgcctgtaatcccagcactttgggaggccgaggcgggcagatcatgaggtcaggagatcgagatcatcttggctaatatggtgaaaccctgtctgtactaaaaatacaaaagattagccaggcgtggtggcgggcccctgtagtcccagctactcgggaggctgaggcaggagaatggcatgaacctgggaggcggagcttgcagttagccgagattgagccactgcactccagcctgggtgacagagcaagactccgtctcaaaaaaaaaaaaaaaaaaaaaatcacacctgtaatcccagcactttgggaggctgaggcgggcagatcacgaggtctggagatcaagaccatcctggctaacacggtgaaatcccgtctctactaaaaatacaacaaattagctgggcgtggtggtaggcgcctgtagtcccagctactcgggaggctgaggcaggagaatggcatgaacccaggaggcagagcttgcagtgagccgagatcgtgccactgcactccagcctgggcgacagcgcaacactccttctcaaaaaaaaaaaaaaatgtgtttgcaggcagtatgctttgtgaaagtcatcgccattctccattctctattaatcagggacacaatgcactgtggaaggccgcagggacccctgcccaagaaagcctgggtattgtccaggtttccccggactgagacagcctgagatatggcctcgtggggagggaaagaccttacagccccccagcccgacacccgtaaagggtctgtgctaaggagattagtgaaataggaaggcctctatgcggtagagataagagtgtggcatctgtctcctgcacgtccctgggaatggaatgtctcggtgtaaaacccgaccatacattctatttactgagataggagaaaacctccttatggctggagatgagacatcatggcggcaatactgctctgttactctttactgcactgaggtgtttatgtaagcttaaacataaatctagcgattgtgcacatccaggcacagcaccttttcttaaacttattcatgacacagagtctttgctcacatggtcttctgctgatcctctccccaccttcaccctatagccccgccacattccccttgctgagatagtaaagatagtgatcaataaatactgagggaactcagagaccagcgctggtgcaggtcctcacttgctgagcgccggtccctgggcccatttttcttccgctatactttgtctctatgtcttatttccttttctcagtctctcgtctccaccttgcgagaaatacccacaggtgtgcaggggcaggccctcttcatctggtgcccaatgtgggttcctttctctacggtgaagatacgctagagtgtgatcattgaagacaaatcgacgagagattcccgaagacttccatgatcagccttgtggtaagcttgtgcactcagagaaacccagggtaagaatgggtcaaactgaaagcaaatatgcctcttatctcagctttattaaagttattttaagaagagggggagttagagcctccacagaaatctaatcatgctatttcaaacaatagaacaattctgcctatggtttccagaatagggaacgttagatctaaaagactgggaaaaaattggcaaagaattaaaacaagcaaatagggaggataaaatcatcccacttacagtatggaatgattgggccattattaaaataggtttagaatcatttcaaacagaagaagatagcgtttcagtttctgatgcccctgaaagctgtgtaatagattgtgaggaagaggcagggacagaattcaagaaagtaacgcaaggttcacagtataaaaaggtagatgagtctggctgggcgcagtggctcacacctgtaatcccagcactgtgggaggccgaggcggatggatcacaaggtcaggagatcgagaccgtcctggctaacacagtgaaaccctgtctttactaaaaaaatacaaaaacttagccaggcgtcgtggcaggtgtctgtagtcccagctactcgggaggctgaggcaggagaatggcgtgaacctgggaggcggagcttgcagtgagccgagatggcaccactgcactccagcctgggcaacagagcgagactccgtctcgaaaaaaaaaaaaagaaaaaaagggtagaagagtgtaatggctcagtcaacggaaaatgttgactacaaccaattacaggaggtaatatattatgaaccatcaaaattggggggaaaaggtctagaactattggggccatcagagtctaacccacgatggccaactcctcctcccacagttcagatgcccgtaacattacaacctcaaatgcaggttagacaagtacaaaccccaagagaatatcagatagaaaaggatagtctctatcacagcaatgccaatccagatacagtattcacaatatcagctggtagaaagtaagacccaaccgccagtaccctatcaatactgaccgccagccgaacttcagtatcagccgccccccagaaaatcagtatggacagccaggaacgtttccagcaccacagggcacgcacggcgatatagcctcagctgcccactatgagacttaatcctacaccaccacctagtggacaggatggtgcattacatgaaattattgagaaggcaagaaaacaaggagagatactgaggcgttttaatttcaagtaatattagagcccatactacctggagaagggccctccccaagctgatgccagatatgagtccttttctataaaaatgctaaaagacatgaaagagggagtaaaacagtatggacccaattctccttatatgagaacattattagattccattgctcatggaaatagacttattccttatgactgggaaattttggccaaatcatcactctcaccttctcaatttttacaatttaagacctggtggattgatggggtacaacaacagatccgcaaaaatagggccgccaatcccagttaacatagatgcaggtaaaaaatagaaaaattaaaccacaaaaaatagaaataagaaaagacacattaaaaacattaaatgactttcaaaaattgctaggagatattaattggatttggccaattttaggcattcctacttatgccatgtcaaatttgttctctatcttaagaggggacccggacttaaatagtaaaagaatattgaccccagaggcagcaaaagaaattgaattagttgaagaaaaaatttggtcagcacaagtaaatagaatagatcccttggtcccactccaacttttgatttttgctactgcacattctctgacaggcatcattgttcaaaatactgatcttgtggagtggtcattccttcctcacagtacaattaagacttttacattgcatcaaatagctacattaattggtcaggcaaggttatgaataataaaattgtgtggaagtgacccagacaaaatcattgttcctttaaacaaggaacaggttagacaagcctttatcaattcttgtacatggcagactggtcttgctgattttgtgggaattattgacaatcattacccaaaaacaaaaaccttccagtttttaaaattgactacttggattttacctaaaattaccagacatgaacctttagaaaatgctctgacggtgtttactaatggttccagcaatgaaaaagcagcttacattgggccaaaagaacaagtcatcgaaactcaatatcactgggctcaaagagcagagttggttacagtcattacagtgttacaagattttaatcagcctattaatattgtatcagattctgcatatgtagtacaggctacaagggatgttgagacagccctaatcaaatatagtattgatgatcagttaaaccagctgttcaacttattacaacaaactgtgagaaaaagaaatttcccattttgtattactcacattgaagcacacactaatttaccagggtctttaactaaagcaaatgaacaagctgacttactggtatcatctgcattcataaaagcacaagaacttcatgctttgactcatgtaaatgcagcaggattaaaaataaatttgatatctcatggaaacaggcaaaaaatattgtacaacattgcacccagagtcaagtcctacacctgcccactcaagaggcgggagttaatcccagaggtctatgtcctaatgcgttatggcaaacggatgtcacacatgtatcttcatttggaaaattatcatttgtccatgtgacagttgatacttattcacatttcgtatgggcaacttgcgagacaggagaaagtacttcccatgttaaaagacatttattatattgttttgctctcatgggagttctggaaaaaattaaaactgacaatgggccaggatactgtagtaaaacattccaaaaattcttaaatcagtggaaaattacacatacaacaggaattccctataattcccaaggataggccatagttgaaagaactaatagaacactcaaaactcaattggttaaacaaaaaagaactctccctttccctctccctctccccctccctctccatctctgtctccatctccctctccccacggtctccttctccctgtctttccacggtctccctctgatgccgagccgaagctggactgtactgctgccatctcggctcactgcaacctccctgcctgattctcctgcctcagcctgctgagtgcctgggattgcaggcacgcgccgccacgcctaactggttttcgtatttttttggtggagacggggtttcgctgggttggccgggctggtctccagctcctaaccgcgagtgatctgctagcctcagcctcccgaggtgccgggattgcagacggagtctcgttcactcagtgctcaatgttgcccaggctggagtgcagtggcgtgatctcggctagctacaacctccacctcccagccgcctgccttagcctcccaaagtgcggagattgcagcctctgcccggccgccaccccgtctgggaagtgaggagcgtctctgcctggccgtccatcgtctgggatgtgaggagcccctctgcccggctgcccagtctgggaagtgaggagcgcctcttcccggccgccatcccatctaggaagtgaggagcgtctctgcccggccgcccatcgtctgagatgtggggagcgtctctgccccgctgccccgtctgggatgtgaggagcacctctgcccggccgccaccccatctgggaggtgaggagcgtctctgcccggctgccccgtctgagaagtgaggagcccctccgcccggcaggtgccccatctgagaagtgaggagcccctccacccggcaggcgccccttctgggaagtgaggagcgcctccgcccggcagctgccccgtccgggagggaggtggggggccctccgggagggaggtgggggtcagcccccgccaggccagccgccccgtccaggagggaggtgggggggtcggccccccgcccggccagtcgccccatccgggaggtgaggggtgcctctgcctggctgccccaactgggaagtgaggagcccctctgcccggccagccgccccatccgggagggaggtgggggggtcagtcccccgcccggccagccgccccgtccgggagggaggtgggggggtcagccccccgcacggccagctgccccgtccgggtggtgaggggcacctctgcccggccgcccctactgggaagtgaggagcccctctgcccggccagccgccccgtccgggagggaggtgagggggtcagccccctgcccggccagccgccccgtccgggaggtgagggacgcctctgcccggccgcccctgctgggaggtggggagcccctctgcctggccaccaccccgtctgagaggtgtgcccaacagctcattgagagcgggccgggatgacaatggcggctttgtgcaatagaaaggggggaagggtggggaaaagattgagaaatcggatggttgcggtgtctgtgtagaaagaggtagacatgggagacttttcattttgttctgtactaagaaaaattattctgccttgggatcctgttgatctgtgaccttacccccaaccctgtgctctctgaaacatgtgctgcgtccactcatggttaaatggattaagggtggtgcaagatgtgctttgttaaacagatgcttgaaggcagcatgctcgttaagaatcatcaccactccctaatctcaagtacccagggacacaaacactgcggaaggccgctgcctaggagaaccagagacctttgttcacttgtttatctgctgaccttccctccactattgtcctatgaccctgccaaatccccctctgtgagaaacacccaagaatgatcaataaaaattaaaaaaaaaaacaaaaaaaaaaaaacaaaaaaaaaaagaaaaagctgacacagttctctgaaaaaagcctagagaacacaagggtgacacaaactccagagagtatgctgcttgcagctttgatgattgtatcaacagtggtaagtcaccccatgtctgcaggagcagctgcagctaattatacctactgggcctatgtgcctttcccacccttaattcgggcagtcacatggatggataatcctattgaagtatatgttaataatagtgcatgggtacctggccccatagaggatcgttgccctgcccaactcgaggaagaaggaatgatgatgaatatttcaattgagtatcgttatactcctatttgcctagggagggcacaaggatgcttaatgcctgaaacccaaaattggttggtagaagtacctactgtcagtaccaccagtagatttacttatcacatggtgagtggaatgtcactcaggccacaggtaaattatttacaggacccttcttattaaagatcattataatctaagtctaaggggaagccttggcccaaggaaattcccaaaggatcaaaaagcccagaagttttagtttgggaagaatgtgtggctgatagtgcggtgatactacaaaacaatgaattcagaactattatagattgggcatctcgaggtcaattctaccgcagttgcacaggacaaactcaatcttgttccagtgcacatgtgagtccggctgtgaacagtgacttcagagaaggtttagataaaaataagtacaaaaggttagaatctccctacccttgggaatgggcagaaaaaggaatctctgctacaagaccaaagataataagtcctgtcattggtcctgaacatctagaattatggaggcttatgtggcctcgcaccacattggaatttggtctggaaatcaagttataggaacaaaagaccgtaagccatcttatactattgacctaaattccagtctgacaattcctttgcaaagttgtgtaaaacccccttatatgctaattgtaggaaacatagttattaaaccagattcccaaactataacctatgaaaattgtagattgtttactagcattgattcgacttttaattggcagcaccgtattctactagtgagagcaagagagggcgtgtggattcctgtgtccatggaccgaccgtgggaggcttcgccatctgtccatattttgactgaagtattaaaaggagttctaaatagattcaaaagattcatttttactttgatgcagtgattatgggattaattgcagtcacagctacggctgctgcggcagaagttgcattgcactcttctgttcagacagtacgctttgttaacaattggcaaaaaaattctatgagattgtggaattcacaatctggtattgatcaaaaattgtcgaacccaattaatgatcttagacaaactgtcatttggatgggagataagctcatgagcttggaaatcgttttcagttacactgtgactggaatacatcagatttttgtattacaccccgagcctataatgagtctgagcatcactgggacatggttagacgccatctacagggaagagaagataatcttactttagacatttcaaaattaaaagagcaaattttcaaagtatcaaaagcccatttacatttcgtaccaggaacttaggcaatcgcaggagctgctgatggcttcacaaatcttaaccctgtcacttgggttaaaaccctcagaagttccactattgtaaatttcatattaatccttgtgtgcctattctgtctgttgttagtctacaggtgtaaccagcagctccgaagagacagtaaccatcaagaacaggccataatgaagatggcggttttgtcaaaagaaaagggggaagtgtgaggaaaagaaaaagagatcagattgttactgtgtctatctaggaaaaggaagacaaaagaaactccattttgatctgtactaagaaaaattgttctgctttgagatgctgttaatctgtaactcttgtcccaaccctgtgctcgcaaaaacatgtgctgtattgactcaaggtttaagggagggctgtgcaggatgtgctttgttaaaaatgtgtttgcaggcagtatattggtgaaagtcatcgccattctccattctctgttaaccagggacacaatgcactgtggaagtctgcagggacccctgcccaagaaagcctgggtattgtccaggtttcccccgactgagacagcctgagatatggcctcatgggaagggaaagaacttacagccccccagccctacacccgtaaagggtctgtgctaaggaggattagtgaaagaggaaggcctctatgcggttgagataagagcgtggcatctgtctcctgcacgtccctgggattggatgtctcagcataaaaccgaccatatattctattctgagacaggagaaaaccaccttatggctggaggtgagacatcatggcggcaatactgctctgttactctttactgcactgagttgtttatgtaagcttaaacataaatctagcgattgtgcacatccaggcacagcaccttttcttaaacttatttatgacagagtctttgctcacatgttcctctgctgaccctctccccaccttcaccctatagccccgccacactcccctcgcagagatagtaaagatagtgatcaataaatatggagggaaccagagaccagtgccagtgcaggtcctcacttgctgagtgccggtcccctgggcccacttttcttcctctatactttgtctccgtgtcttatttcttttctcagtcgctcgtctccatcttgcgagaaatacccacaggtgtggaggggcagcctcccttca

SEQ ID NO: 232 - DNA, 683 bp, Homo sapiens
ttggagtaggtagctaggcagacatgagcagggcaggagagggccctcctcaggaatgtcaggctaccatcaggagataggcagtcattaaacagtctctccaaaataataattggtcgcagccagtgccagggaaaggcagtctcccaacagatagcaaactcttggtgatcagcagcttcccgacaagatctcagaagttgggctagtgggctcaagcatgtgcagtaactgacaaaatggcggagtttaactagtatatgaccttcctctgggaacacttgactgctaagggaaaaatgccttgaatgagtatgcacacaacttcagtaaacacactgcacatgcagcacctcccaagtgctggcaggctactgagcatgcaaacagtccactccaagggaagaatcagcggagaagaaatgcaaacctcagaaccattccaatgtataaaaacccaagtcaaaggttagatggggcacttggatctctcaagttgtccgcttggccctcttccaagtgtactgtacttcctttcattcttgctctagaatttttaataaactctcactcttgctctgaaacttgtctcagtctctcactctgccttatgtcccttagctgaattctttcctctaacaaggcaaaaatccagtttgctgcagatccgatggattcagtgc

SEQ ID NO: 233 - DNA, 968 bp, Homo sapiens
gggggaaagaaagagagatcagactgttactgtgtctatgtagaaaaaggaagacataagaaactccattttgacctgtactaagaaaaattattctgccttgagatgctgttaatctgtaaccctagccccaaccctgtgctcacagaaatgtgctgtattgactcaaggtttaatggagttagggctgtgcaggatgtgcctttgtaaacatgtgtttgcaggcagtatgcttggtaaaagtcatcgccattctccagtctcgggtacccagggacacaatgcactgcggaaggccgcagggacctctgcctgagaaagcctgggtattgtccaaggtctcccccaactgagacagcctgagatgtggcctcatgggaaaggaaagatcttactgttcccccagcctgacacctgtaaagggtctgtgctgaggaggattagtgaaagaggaaggcctctttgcagttgagataagggaaggcacctgtctcctgctcatccctgggcaacagaatgtctcagtgtaaaacccaattgtatattccatctactgagataggagaaaaccgccttagggctggaggtgagacatgctggaggcaatactgctctttaatgcattgagatgtttatgtatctgcacatcaaaagcacagcacttttttctttaccttgtttatgatgcagagacatttgttcacaggttttcctgctgaccctcttgcctctattaccctgttgtcctgccacatccccctctccgagatggtagagataatgatcaataaataccgagggaactcagagaccagtgccatcagggttcctccgtatactgagccccggtcccctgggcccacttttctttctctatactttgtctctgtctcttatttcttttctcagcctctcatcccacctgatgagaaatgcccacaggtgtggaggggcaggccaccccttca

SEQ ID NO: 234 - DNA, 570 bp, Homo sapiens
ttagagtaggtagttaggcagacaagagtagcctggagaggcccctctcccctgctgggaatgtcaggtgaccatcaggtgatggtaaggtggttgttaaactctctctctaaaataataattggtcacagccagcaccaaggaaaggtagtctcccaatagagagaaaacacctgaagctggttgtcagcagcttcccaataaggtctcatgagctgggcaagagggctcaagcatgtgcactaaaaggcaaaatggcggaggaatttaacttgtatatgaccttcctgcaggaacatttgactggttagggaaaaatgcctcaactgagcatgcacacaacttcagtagacacactgtgcatgcggaccctcccaagtgctggcagggcactgcacatgccgacagcctgccccaagggaaaaatcaagggaggaaaaacacaaaccctgaagccatgccaatgtatacaaccccaagtccagggctgaaccgggcacttggatctctcaagtcacccacttagccctcttccaagtgtattttgctttctttacctcctgctctaaa

SEQ ID NO: 235 - DNA, 6412 bp, Homo sapiens
gacagacaggactagctggatttcctaggccaactaagaatccctaagcctagctgggaaggtgaccgcatccacctttaaacacggggcttgcaacttagctcacacccaaccaatcagagagctcactaaaatgctaattaggcaaaaacaggaggcaaagaaatagccaatcatctattgcctgagagcacagtgggagggacaaggatcgggatacaaacccaggcgttcaagctggcaacagcaaccctctttgggtcccctctctttgtgtgggagctctgttttcactctatttcactctattaaatcttgtaactgcactcttctggtccatgtttgttatggctcgagctgagctttcgctcgccatccaccactgctgtttgccgccatcgcagacccgccaccgcagacctgccactgcagacccaccactgactcccatccctccggatccagcagggtgtccgctgtgctcctgatccagcgaggtgtccattgccactcccaatcaggctaaaggcttgccattgttcctgcacagctaagtgcctgggttcatcctaatcaagctgaacactagtcactgggttccacggttctcttccgtgacccatgtcttctaatagagctataacactcaccgcatggcccaagattccattccttggaatccgtgaggccaagaaccccaggtaagagaacacgaggcttgccaccatcttggaagtggcctgccaccattgtggaagtggcccacaaccatcttgggagctctggaagcaaggacccccggtaacattttggtgaccacgaagggacatccaaagcggtgagtaatattggaccactttcgcttgttattctgtcctatccttccttagaattggaggaaaatactgggcacctgtcagccagttaaaaacgattagcgtggccgccggacttaagactcaggtgttacgctatctgcggaagggctttctaacaacccccaacccttctgggttggggacgttggtctgcttggagccagcttccactttcaattttcttggggaatccgagggctgactagaggcagaaagctgtcgtccagaactcccggcattagcctgttgagatcatggcgcagccagaagtctctactcaacagtcgcccatgggtgcgcccctacctttccttctgacccatacctcatgggtcctgaccacgactttcttgaaagtgtagccccaaaattctccttacctttgaatctacttcctctgatccctgcctcctaggtactaatggttcacactttcatttcctctagcaagttgtatctccaaagggatctagggaggctctgcgttgtgtccttaggcacctgggctgtaacccagggagtcttatccctggtgtccctcctgattcaggtatgcagctctcgacatgggcagttatgtgggacccgttccccactacccttgccagggccccaagtttgtaatggctgagagagagagagacggagagagagggagagacggagagagagacaaagacagagtcaaagagaaaaagaaagaaaaagatagaataaaaaaaaaaagtgtgccctattcctttaaaagccagcgtaaatttaaaacctgtaattgataattgaaggtcttctctatgactctataatactccaataccactgttgtcaatgtaaataagggcgtagcccaaaagcactgaggccactggcaacctgtagctttcctataaaaaatccttaacccagtaacccgcggatgggccaaatgcattcagtcggtagcggcaactgctttgctaaaagtagaaaagtaacttttagaggaaaccttcttgtgagcacacctcaccagttacattattctaagttaaaaaaaaagcaaaaaggtagcttactaaatcaaaaatcttaaagtatggggctattatgttagaaaagggtaatgtaactccaaccactgataattcacttaacccagcagatttcctaacaaaggatttaaatcttaattaccatacaaaggtccgaccagacctaggaggaactcccttcaggacaggacgatagatggttcctcccaggtgattgagggaaaaaaccacaataggtattcagtaattaatacagagactctgtggaagcagagttagaaaaattgcctaataattggtctcctcaaacgtgcgagctgtttgcactcagccaagcccatacttacataatcaaaagactatttcaatcctgactcaaaaggttcgctacacctctctgaaacgaatttgcataagagtgttgtttatgggaatgcatcttgatggggcagctgggttgttatgaaatacccaggaacccagcccagctctaggactcacccctgagcgcaaaagcaatgtcgggcacgctggtaaaggaccactagaatccagcagcccagacccctttctttgtggtcaagagaggtggaaaaataggtgcaggactgctacattggtgagcgtaactaatccgataagcagaggtccatgggtggttacgcaccctggaaaagaataagcattaggcccttagaggatgctttaggactaatgctcatcggaaaatgactaggggtgctggcatccctatgttcttttttcagatcggaaacgttccccacaccccaaggcaaaaacgcccttaagatgtattctggagaataaggaccaatttgaccctcagacgctaagaaagaaatgacttatattcttctgcagtactgcctggccatgatatcctcttcaagggggagaaacctggcctcttgagggaagtataaattataacaccatcttacagcttgacctcttctgtagaaaggagggcaaatggagtgaagtgccatatgtgcaaacttccttttcattaagagacaactcgcaattatgtaaaaagtgtggtttatgccctacaggaagccctcagagtctgcctccctatctcagcatccccccgactccttctgcaactaataagggaccccccttttacccaaaggtccaaagaagatagacaaagggataaacaatgaaccaaacagtgccaatattccccgattatgccccctccaagcaatgtgaggagcagaattcggcccagccagagtgcatgtacctttttctctctcagacttaaagcaaattaaaatagacctaggtaaattctcagataaccctgatggctatactgaagttttataagggttaggacaatcttttgatctgatgtggagagatataatgttactgctaaatcagacactaaccccaaatgagagaagtgtcgccataactgcagcccgaagagtttggtgatctctggtatctcagtcaggtcaatgataggatgacaacagaggaaagagaacaattccccacaggccagcaggcagttcccagtgtagaccctcattgggacacagaatcagaacatggaaattggtgccgcagacatttgctaacttgtgtgctaggactaaggaaaactaggaagaagcctatgaattatgcaatgatgtccactataacacagggaaaggaagaaaatcctactgcctttctggtgagactaagggaggcattgaggaagcatacctctctgtcacctgactctattgaaggccaactaatcttaaaggataagtttatcactcagtcaactgcagacattagaaaaaaacttcaaaagtccgccttaggcccagagcaaaacttagaccctattgaacttggcaacctcggttttttataatacagatcaggagaagcaggcggaatgggacaaacgggataaaaaaaaaggccactgctttagtcatggccctcaggcaagcggactttggagtctctggaaaagggaaaagctgggcaaatcgaatgcctaatatggcttgcttccagtgtggtctacaaggacactttaaaaaagattgtccaagtagaagtaagctgccccctcgtccatgccccttatgtcaagggaatcactggaaggcccattgccccaggggacgaaggtcctctgagtcagaagccactaaccagatgatccagcagcaggactgagggtgcccggggcaagcaccagcccatgccatcaccctcacagggccccgggtatgcttgaacattgaaggccaggaggttaactgtctcctggacactggcatggccttctcagtcttactctcctgtcccagacaactgtcctccagatctgtcactatccgaggggtcctaggacagccactaagttgtgactggggaactttactcttttcacatgcttttctaattatgcctgaaagccccactcccttgttagggggagacattctagcaaaagcaggggccattatatatctgaacataggagaaggaacacctgtttgttttcccctgcttgaggaaggaattaatcctgacgtctgggcaacagaaggacaatatggatgagcaaagaatgcctgtcctattcaagttaaattaaaggattctacctcctttccctaccaaaggcagtacccttagacctgaggcccaacaaggactccaaaagattgttaaggacttaaaagcccaaggcctagtaaaaccatgcaatagcccctgcaatactccagttttaggagtacagaaacctaatggacagtggaggttagtgcaagatctcaggattatcaatgaggctgttcttcctctataccctgctatacctaacccttgtactctgctttcccaaaaaccacagaaagcagagtggtttacagtcctggaccttaaggatgcctttttctgcatccctgtacaccctgactctcaattcttgtttgcctttgaagatcctttgaacccaatgtctcaactcacctggactgttttaccccaagggttcaagcatagcgcccatctatttggccaggcattagcccaagacttgagccaattctcatacctggacactcttgtccttcagtacggggatgatttaattttagccacccgatcagaaacctggtgccatcaagccacccaagcactcttaaatttccttgctacctgtggctacaaggtttccaaacaaaatgctcagctctgctcacagcaggttaaaaacttagggctaaaattatccaaaggcacaagggccctcagtgaggaacgtatccagcctatactggcttatcctcatcccaaaaccctaaagcaactaagagggttccttggcataacaagcttctgccgaatatggattcccaggtacagcgaaatagtcaggccattatacacactaaggaaactcagaaagccaatacccatttagtaagatggacacctgaagcagaagtggcttttcaggccctaaagaaggccctaacccaagccccagtggtaagcttgccaatggggcaagacttttctttatatgtcgcaaaagaaacaggaatagctctaggagtccttatacaggtccgagggaccagcttgcaacctgtggcatacctgagtaaggaaattgatgtactggcaaagggttggcctcattgtttacgggtagtggcaacagtagcagtcttagtatctgaagcagttaaagtaatacagggaagagatcttactgtgtgaacatctcatgatgtgaatggcatactcactgctaaaggagacttgtggctgtcagacaaccgtttacttaaatatcaggctctattacttgatgggccagtggtgtgactgcgcacttgtgcaactcttaacacagccacatttcttccagacaatgaagaaaagatagaacataaatgccaacatgtgattgctcaaacctaatgctgctcaaggggaccttttaggggttcccttgactgatcccaacctcaacttgtatactgatggaagttcctttgcagaaaaaggactttgaaaagcggggtatgcagtggtcagtgataatggaatacttgaaactaatcccctcactccaggaactagtgctcagcatgcagaactaatagccctcactcgggcactagaattaggagaagggaaaagggtaaatatatatacagactctaagtacgcttacctagtcctccatgcccatgcagcaatatggagagaggggaattcctaacttccgagggaacacctatcaaacatcaggaagccattaggagattactattggctgtacagaaacctaaagaggtggcagtcttacactgccagagtcaccagaaaggaaagggaaacagaaaggaactgccaagcggatattgaagccaaaagagcggcaaggcaggaccctctattagaaatgcttatagaaggacccccagt

SEQ ID NO: 236 - DNA, 6004 bp, Homo sapiens
gtcaggcctccgagcccaagccaagccatcgcatcccctgtgacttgcacgtatatacgcccagatggcctgaagtaactgaagaatcacaaaagaagtgaatatgccctgccccaccttaactgatgacattccaccacaaaagaagtgtaaatggccggtccttgccttaactgatgacattaccttgtgaaagtccttttcctggctcatcctggctcaaaaagcacccccactgagcaccttgcgacccccactcctgcccgccagagaacaacccccctttgactgtaattttcctttacctacccaaatcctataaaatggccccatccttatctcccttcgctgactctctcttcggactcagcccgcctgcacccaggtgaaataaacagccatgttgctcacacaaagcctgtttggtggtctcttcacatggacgcgcatgaaatttggtgctgtgactcggatgggggacctcccttgggagatcaatcccctgtactcctgttctttgctccgtgagaaagatccacctatgaccttaggtcttcagaccgaccagcccaagaaacatctcaccaatttcaaatctggtaagcggcctctttttaccctcttctccaacctccctcactatccctcaacctctttctcctttcaatcttggcgccacacttcaatctctcccttctcttaatttcaattcctttcattttctgatagagacaaaggagacatgttttatccatggacccaaaactccggcgccggtcacggactgggaagacagccttcccttggtgtttaatcattgcagggacgcctctctattcacccacgtttcaaaggtgtcagaccacgcatggacgcctgccttggtccttcacccttagcggcaagtcccgcttttctggggaaggggcaagtaccccaactccttctctccttgtctctaccccttctctgctttccgaggaaagggcgagtatcccaaccccttctctccttgtctctactccttctctgcttttctgggagaggggcaagtacccctcaaccccttctccttcactcttagtggcaagtcccgcttttctagaggagggacaagtgccccaacctcgtatctctgtgccccaatcccttatttccgtgccccaacctcttatatctctgcaccccaatcccttatttcagtgtcccaaccccttatttccgtgccccgaccccttatttctgtgcccctaccccttatttccgtgcccctaccccctatttctgtgcccctaccccttatttccgtgccccttccccttatttccatgccctgaccccttatttctgcgccccatcccttatttctgcatcccaacctcttatctctgtgccccgacctcttatctctgcgccccaaccccttttcccacttttctggaaggtaagaacccccgaaccccttccctctgtttttctctcttttctctaggcttgcttccttcactataggcaaccttccaccctccattcctccttctgctcccttggcctgtgttctcaaaaacttaaaacctcttcaactcacacctgacctaaaacctaaatgccttattttcttctgcaatgccgcttgaccccaatacaaactcgacagtagttccaaatagccagaaaatggcactttgaatttttctatcctgcaagatctaaataattcttgtcataaaataggcaaacggtctgaggtgcctgacgtccaggcattcttttacacatcagccccttcctagtctctgtgcccagtgcaacttgtcccaaatcttccttctttccctcccgcctgtcccctcagtaccaaccccaagcatcactgagtctctctaatcttccttttctacagacccatctgacctctcccttcctccccaggctgctcctcgccaggccgagctaggtcccaattcttcctcagcctccgctcctccaccctataatctttttatcacctcccctcctcacacctggtccggcttacagtttccttccgtgactagccctcccccacctgcccagcaatttactcttaaaaaggtggctggagccaaaggcatagtcaaggttaatgttccttttctttatcccaaatcagaagcatttaggctctttttcatcaaatataaaaatccagcccagttcatggctcctttggcagcaaccctgagacgctttacagccctagaccctaaaaggtcaaaaggccgtcttattctcactatacattttattacccaatctgctcctgacattaaataaaactccaaaaattggaatctggccctcaaaccccacaacaggacttaattaacctcaaccttcaaggtgtacaataacagaaaaaagttgcaattccttgccttcactgtgagacaaaccccagccacatctccagcacacaagaacttccaaacacctgaaccacagcggccaggcattcctccagaacctcctcccacaggagcttgctgcatgtgccaaaaatctggccactgggccaaggaatgcccacagcccgggattcctcctaagctgcgtcccatctgtgtaagaccccactgaaaatcggacggttcaactcacctggcagccactcccagagcccctggaactctggcccaaggctctctgactgactccttcccagatcttctcggcttagcggctgaagattgacactgcccgatcgcctcggaagccccctagaccatcacggacgctgagcttcgggtaattctcacagtggaaggtaagcctgtccccttcttaatcaatacagaggctacccactccacattaccttcttttcaagggcctgtttcccttgcctccataactgttgtgggtattgacagccaggcttctaaacctcttaaaactccccgactctggtgccaacttagacaatactcttttaagcactcctttttagttatccccacctgcccagttcccttattaggctgagacactttaactaaattatctgcttccctgactattcctggactacagctatatctcattgccacccttcttcccaatccaaagcctcctttgcatcctcctcttgtatccccccaccttaacccacaagtataagatacctctactccctccttggcgaccgatcatgcaccccttaccatctcattaaaacctaatcacccttaccccactcaacgccaatatcccatcccgcagcatgctttaaaaagattaaagcctcttatcactcgcctgctacagcatggccttttaaagcctataaactctccttacaattccccgattttacctgtcctaaaaccagataagccttacaagttagttcaggatctgcgccttagcaaccaaattgttttgcctatccaccctgtggtgcccaacccgtacactcttttgtcctcaataccttcctccacaactcactattccgtgcttgatcttaaagatgcttttttcactattcccctgcaccccttgtcccagcctctctttgctttcacttagactgaccctgacacccatcgagctcagcaaattacctaggctattcggccgcaaagcttcacagacagcccccattacttcaatcaagcccaaatttcttcctcatctgttacctatcttggcataattctcaaaaaaacacacgtgctctccctgccaattgtgtccaactgatctctcaaaccccagcaccttctacaaaacaacaactcctttctttcctaggcatggttagcgcggtcagaattcttacacaagagccaggaccacaccctgtagcctttctgtccaaacttgaccttactgttttagcctagacctcaggtctgtgtgcagcggctgccgctgctttaatacttttagaggccctcaaaatcacaaactatgctcaactcactctctatagttctcataacttccaaaatctattttcttcctcatacctgatgcatatactttctgctccgcagctccttcagctgtactcactctttgttgagtctcccacaattactgttgttcctggcccagacttcaatccggcctcccacattattcctgataccacacctgacccccatgactgtatctctctgatccacctgacattcaccccatttccccaagtttccttctttcctgttcctcaccctgatcacgcttgatttattgatggtggttccaccaggccgaatcgccacacaccagaaaaggcaggttatactatagtactagccactagcccgtctcttagaacctctcatttcctttccatcgtggaaatctatcctcaaagaaataacttatcagtgttccatctgctattctactactcctcagggattattcaggccccctcccttccctacacatcaagctcaaggatttgcccccacccaggactggcaaattagctttactcaacatgccctgagtcagataactaaaatacctcttagtctagatagatactttcactggataggtagaggcctttcctacagggtctgagaaggccactgcagtcatttcttccattctgtcagacataattcctcagtttagccttcccacctcaatacagtctgataacagacgagcctttattagtcaaatcagctaagcagtttttcaggctcttagtattcagtgaaacctttatatcccttacggtcctccatcttcaagaaaagtagaatggactaaaggtcttttaaaaacacacctcaccaagctcagccaccaacttaaaaaggactggacaatacctttaccactttcccttctcagaattcaggcctgtcctcagaatgctacaaggtacagcccatttaagctcctgtatggacgctcctttttattaggccccagtctcattccagacaccagaccaacttagactgcaccccaaaaaacttgtcatccctactatcttctgtctagtcatactcctattcaccgttctcaactactcatacatgccctgctcttgtttacactgccggtttacactgtttctccaagccatcacagctaatatctcctggtgctatccccaaactgccactcttaactcttgaagtaaataaataatctttgctggcaggaatatgctgaatctccttaggcactctctaatcagatatcctgagtcgtcccaattcttagaccttttatacctgtttttctccttctgttattccatttagtttctcaattcatcccaaaccgtatctaggccatcaccaatcattctataagacaaatgtttcttctaacatccccacaatatcaccccttaccacaagacctcccttcagcttaatctctcccactctaggttcccatgccgcccctaatcccgcttgaagcagccctgagaaacatctcccattctctctccataccaccccccaaaattttcgccgccccaacacttcaacactattttgttctatttttcttattaatataagaaggcaggaatgtcaggcctctgagcccaagccaagccatcccctgtgactggcacgtatatgtccagatggcctgaagtaactgaagaatcacaaaagaagtgaatatgccctgccccaccttaactgatgacattccaccacaaaagaagtgtaaatggccggtccttgccttaactgatgacattaccttgtgaaagtccttttcctggttcatcctggctcaaaaagcacccccactgagcaccttgcgacccccactcctgcccgccagagaacaaaccccctttgactgtaattttcctttacctacccaaatcctataaaatggccccacccttatctcccttcgctgactctctttttggactcagcccgcctgcacccagatgaaataaacagccatgttgctcacacaaagcctgtttggtggtcccttcacacggacgcgcatgaaa

SEQ ID NO: 237 - DNA, 350 bp, Homo sapiens
gccatttcctgccttaactgatgacattccaccacaaaagaagtgaaaatggcctgttcctgccttaactgaagacattgtcttgtgaaattccttctcctggctcatcctggctcaaaagctcccctaccgagcaccttgtgacccccactctcctgcccaccagagaacaacccccctttgactgtaattttcctttacctaccctaatcttataaaacagccccaccccatctctctttgctgactctctttcagactcagcctgtctgtctgcatccaggtgattaaaagctttattgctcacacaaagcctgtttagtggtctcttcacacagacgcacatgaaa

SEQ ID NO: 238 - DNA, 964 bp, Homo sapiens
gtgggggaaataaagagagatcaggctgttactgtgtctatgcagaaagaagaagacataagaaactccattttgttctgtagtaagaaaaattcttctgccttgagatgctattaatctgtaacgctagccccaaccctgtggtcacagaaatatttgctgtgttgactcaaggtttaatggatatagggctgtgcaggatgtgctttgttaaaaatgtgtttgcacgcagtatgcttggtaaaagtcatcacccttctctggtctcaagtacccagggacacaatgcactgtcgaaggccacagggacctctgcccaagaacgcctgggtattgtccaaggtttctccccactgagacagcctgagacatggcctcgtgggaagggaaagaccttaccgtcccccagcccgatacccataaagggtctgtgctgaggaggattagtgaaagaggaaggcctctttgcagttgagataagaggaaggcatctgtctcctgctcgtccccgggaatggaatgtcttggtgtaaaacccgaacgtacattctatttactgagatgggagaaaactgccttatggctggaggtgagacatgctggcgacaatactgctctttactgcactgagatgtttgtgtaaagtcaaacataaatctggcctacaagcacatcgaggcacagcacctttccttaaacttatttatgacacagagtcctttgttcacatgttttcctgctgaccctctccccaccctgccacatccccctcaccaagatagtagagatagtgatcaataaatactgagggaactcagagaccagagccggtgcgggtcctccatatgctgagcgctggtcctctgggcccactgttctttctctatactttgtctctgtgtcttatttcttttctcagtctctcatcacacctgatgagaaatacccacaggtgtggaggggc

SEQ ID NO: 239 - DNA, 5784 bp, Homo sapiens
gtcagacttctgagcccaagctaagccatcatatcccctgtgacctgcacgtacacatccagatcgctggttcctgccttaactgatgacattccaccacaaaagaagtgaaaatggcctgttcctgccttaactgatgacattgtcatgtgaaattccttctcctggctcatcccagctcaaaagctcctccactgagtaccttgtgaccccccactcctgcctgccagagaacaacacccctttttcctttacctacccaaatcctataaaacggccccacccctatctcccttcactgactcttttcggactcagcctgcctgcacccaggtgaaataaacagccacgttgctcacacaaagcctgtttggtggtctcttcacatggatgcgcatgaaatttggtgccgtgactcagatcgggggacctcccttgggagatcaatcccctgtcctcctgctttttgctccatgagaaatgtccacctacgacctcaggtcctcagaccgaccagcccaaggaacatctcaccaatttcaaatccggtaagaggcctctttttactctcttctccaacctccctcactatccctcaacctctttctcctttcagtcttggcaccacacttaatctctcccttctcttaatttcaattcctttcattttctggtagagacaaaggagacacattttatccatggacccaaaactccggcaccagtcatggactgggaaggcagccttcccttggtgtttaatcattgcagggacgcctctctgattattcacccatgtttcagaggtgtcagaccacgcagggatgcctgctttagtccttcacccttagcggcaagtcccgcttttctgtgggaggggcaagtaccccaaccccttctctccatgtctctaccccttctctgcctttctggggggcaagaaacccccaaccccttctccttcacccttagcagcaagtcctgcttttctaggggagggtcaagtaccacaaccccttatatctctgtgccccgatcccttatttccacaccccaacctcttatatctctgtgccccgatcccttatttccacaccccaacctcttatatctctgtgccccgatcccttatttctgcaccccaacctcttatatctctgtgccccaatcccttatttccacgccccaacctcttatatctctgtaccccaatcccttatttccacaccctgatgtcgtatctctgtgccccaaccccttctctgcttttctggagggcaagaataccccaccctttctctgtgtctctactgttttctctgggcttgcctccttcactatgggcaagcttccaccttgcccattcctccttcttctcccttagcctgtgttcttaagaacttaaaacctcttcaactctcacctgacctaaaatctaagcatttgattttcttctgcaatgccgcttgactccaatacaaactcgacagtagttccaaataaccggaaaacggcactttcaatttttccatcctacaagatctaaataattcttgtcataaaatgggcaaatggtctgaggtgcctgacatccaggcattcttttacacatcggtccctccctagtctctgtgcccaatggaactcgtcccaaatcttccttctttccctcccgcctgtcccctcagtcccaaccccaagcgtcactgagtctttctaatcttccttttctacagacccatctgacctctcccctcctccccaacctgctcctcgccaggccgagctaggtcccaattcttcctcagcctccgctcctccaccctataatccttttatcacctcccctcctcacacccggtctggtttacagtttcattccgtgagtagccctcccccacctgcccagcaatttcctcttaaaaaggtggctgaagctaaaggtatagtcaaggttaatgctcctttttctttattagacctctcccaaatcagtgagcatttaggctctttcatcaaatatgaaaaactcagcccagttcatggctcatttggcagcaaccctgagacactttacagccctagaccctaaaaggtcaaaaggccgtcttattctcaaaatacattttatcacctaatctgctcccgacattaaataaaactccaaaaattaaattccagccctcaaaccccacaacaggatttaattaaccttgccttcaaggtgtacaataatagaaaaaagttgcaattccttgcctccactgtgagaaaaaccccagccacatctccagcacacaagaacttccaaatgcctgaaccgcagcagccagaacctcctcccccaggagcttgctacaagtgccagaaatctggccaccaggccaaggaatgcctgctgcccaggattcctcctaagccgcgtcccatctgtgcaggaccccactggaaatcggactgtccaactcacctggcagccactcccagagcccctggaactctggcccaaggctctctgagtccttcccagatcttcttggctcagcggctgaagattgacactgcccgatcacctcggaagccccctagaccatcacggacgccgagctttgggtaactctcacagtggaaggtaagtccgtccccttagtcaatacggagggcacccactccacattaccttcttttcaagggcctgtttcccttgcctccataactgttgtgggtattgatggccaggcttctaaatccctgaaaactccccaactctggtgccaacttggacaacactcttttatgcactcttttttagttatccccacctgcccagttcccttattaggctgagatattttaaccaaattatctgcttccctgactattcctggactacagccgcatctcattgccacccttctccccaacccaaagcctccttcgcgtcttcctctcgtatccccccaccttaacccacaagtatgggacatctctactccttccctggcaaccgatcacatgcccattaccatcccattaaaacctaattacccttaccccgctcaatgccaatatcccatcccacagcacgctttaaaaggattaaagcctgttatcactcgcctgctacagcatgggcttctaaaacctataaactctccttacaattcccccattttacctgtctaaaaaccggacaagtcttacagattagttcaggatctgcgccttatcaaccaaattgttttgccatccatcctgtggtgcccaacccatacactcttttgtcctcaataccttcctccacaactcactattccgttctcgatcttaaagatgcttttttcactattcccctgcacccctcttcccagcctctctttgctttcacttagactgaccccgacacccattaggctcagcaaattacctgggctgtactgccgcaaagcttcacagacagcccccattacttcagtcaagctgaaatttcttccttatctgttacctatctcagcataattctcataaaaacacacgtgctttccctgctgatcgtgtccgattaatctcccaaacctcaatcccttacaaaacaacaactcctttccttcctaggcatggttagtgcagtcagaattcttacacaagagccaggaccacaccctgtagcctttctgtccaaacaacttgaccttactgttttagcatagccatcatgtctccgtgcagtggctgctgccgccctaatacttttagaggccctcaaaatcacaaactatgctcaacttactctctacatttcttataacttccaaaatctattttcttcctcatacctgatgcatatactttctgctccccggctccttcagctgtactcactctttgttaagtcccacaattaccatagttcctggcccggacttcaatccggcctcccacattattctggataccacacctgaccctcatgactgcatctctctgatccacctgacattcaccccatttctccatatttccttctttcctgttcctcaccctgatcacgcttgatttattaatggcagttccaccaggcctaatcgccacacaccagcaaaggcaggctatgctatagtacaagccactagcctgcctcttagaacctctcattttctttccatcgtggaaatctatcctcaaggaaataacttctcagtgttccatctgctattctgctactcctcagggattattcaggctccctcccttccctacacatcaagctcaaggatttgcccccacccaggactggcaaattagctttactcaacatgcgagtcagataactaaaatacctcttagtctaggtagacactttcactggataagtagagtcctttcctacaaggtctgagaaggccaccgcagtcacttctttccttctgtcagacataattcctcagtttagccttcccacctctatacagtctgataacagaccagcctttattagtcaaatcagccaagcagtttttgaggctcttagtattcagtgaaacctttatatcccttacagtcctcagtcttcaggaaaagtagaacggactaaaggtcttttaaaaacacacctcaccaagctcagccaccaacttaaaaaggactggacaatacttttaccactttctcttctcagaagtcagacctgtcctcagaatgctacagggtacagcccatttgagctcctgtatagatgctcctttttattaggccccagtctcattgcagacactagaccaacttagactgtgcccccaaaaaacttgtcatccctactatcttctgtctagtcatactcctattcaccgttctgaactactcatacatgccctgctcttgtttacactgccggtttacactgtttctccaagccatcacagctgatatctcctggtgctatccccaaactgccactcttaactcttaaagtaaataaataatctttgctggcaggactatgctgaatcttcttaggcgctctctaatcagatgtcctgaatcgtcccaattcttagacctcttatacctgtttttctccttctcttattccatttagtttttcaattcgtacaaaactgtatccaggtcatcaccaataattctaaattacaaatgttccttataacaaccccacgatatcaccccttaccacaaaatcttccttcagcttaatctctcccactctaggttcccacactgcccctaatcctgctggaagcagccctgagaaacatcacccattatctctccataccacccccaaaaattttcaccatcctaacactttaccactatttcattttatttttcttattaatataagaagacaggaatgtcaggccgctgagcccaagctaagccatcatatcccctgtgacctgcacgtacacatccatatccccggttcctgccttaactgatgacattccaccacaaaagaagtgaaaatggcctgttcctgccttaactgatgacattgtcttgtgaaattccttctcctggctcatcctggctcaaaagctcccccactcagtaccttgtgatcccccactcctgcctgccagagaacaacccccctttttcctttacctacccaaatcctataaaacggccccacccctatctccctttgctgactctcttttcggactcagcccacctgcacccaggtgaaataaacagccatgttggttgctcacacaaagcctgtttggtggtctcttcacacagatgcgcatgaaa

SEQ ID NO: 240 - DNA, 789 bp, Homo sapiens
aaacaatctggaatcatcaccgagaaagttaaagaaattcgagatcaaatacaacgtagagcagaggagcttcaaaacaccagaccctggggcctcctcagccaatggatgccctggagtctccccttcttaggacctctagcagctataatattgctcctcctctttcgaccctgtatctttaacctccttgttaagtttgtttcttccagaatcgaagctgtaaagctacaaatggttcttcaaatggagctccagatgcagtccatgactaagatctaccacggacccctggaccagcctgctagcccatactccgatgttaatgacatcgaaggcacctctcctgaggaaatctcaactgcacaacccctattatgccccaattcagcaggaagcagttagagcggtcatcggccaacctctccaacagtacttgggttttcctgctgagaggggggactgagagacaggactagctggatttcctaggccaactaagaatccctaagcctagctgggaaggtgaccgcatccacctttaaacacggggcttgcaacttagctcgcacccaaacaatcaggtagtaaagagagctcactaaaatgctaattaggcaaaaatagtaggcaaagaaatagccaatcatctatcgcctgagagcacagcaggagggacaatgatcgggatataaacccaggcattcgaggcagcaacggctaccctttttgggtcccctccctttgtatgggagctctgttttcgctctattaaatcttgcaactaca

SEQ ID NO: 241 - DNA, 4545 bp, Homo sapiens
gtggggaaaagaaagagatcagattgttactgtgtctgtgtagaaagaagtagacataggagactccattttgttctgtactaagagaaactcttctgccttgagatgctgttaatctgtaaccttacccccaaccccttgctctctgaaacatgtgctgtgtcaactcagggttaaatggatcaagggcggtgcaagatgtgctttgttaaacagctgcttgagggcagcatgctccttaagagtcatcaccactccctactctcaagtacccagggacacaaaacactgcggaaggccgcagggacctctgcctaggaaagccaggtattgtccaaggtttctccccatgagatagtctgaaatatggcctctgggaagggaaagacctgaccatcccccagtccgacacccgtaaagggtctgtgctgaggaggattagtaaaagaggaaggaatgcctctttgcagttgagacaagaggaaggcatctgtctcctgcccatccctgggcaatggaatgtctcggtataaaacccgattgtatgttccatctactgagatagggggaaactgccttagggctggaggtgggacatgcgggcagcaatactactctttaaggcattgagatgtttatgtgtatacatatctaaagcacagcacttaattctttaccttgttcaagatgcagagacctttgttcatgtgtttatctgctgaccttctctccactattatcctatgaccctgccacatcaccctctccgagaaacacccaagaatgatcaataaatactaacggaactcagaggccgaggtgggatcctctatatgctgaatgctggtcccctgggcccccttatttctttctctatactttgtctatgtgtctttttctttttcaagtctctcattccacctaacgagaaacacccacaggtgtggaggggcaacctaccccttcatctggtgcccaaggcttttctctagggtgaaggtacgctcgagtgtggtcattgaggacaagtcgacgaagagatcctgagtacgtctacagtcagccttacggtaagcttgtgcactcggaagaagccagggtaacaatggggcaaactaaaagtaaatatgcctcttatcccagctttattaaaattcttttaaaaagagggggagttagagtatctacaaaaaatctaatcaagctatttcaaacaatagaacaattttgcccatggtttccagaacaaggaactttagatctaaaagactggaaaaaaattggcaaagaactaaaacgagcaggtagggagggtaaaatcatcccacttacattatggaatgattgggccattattaaagcatttttagaaccatttcaaacagaagaagatagcatttcagtttctgatgcccctggaagtggtgtaatagattgtaaagaagagacagggagaaaatcccagaaaaaaatggaaagtttacattgtgcgaatatgtagcagagccggtaatggctcagtcaatgcaaaatgttgactataaacaattacaggaggtgatatatcctgaaacgttaaaattagaagaaaaaggtccagaattagtgaggccatcagagtccaaaccacgagagccaagtccttttctagcaggtcagatgcccataacattacaacctcaaacgcaggttagagaaaataagacccaaccaccagtagcttatcaatactggccactggctgaacttcagtatcagccacccccagaaagtcagtatggacatccaggaatgctgccagcactacagaatagggtgccacaccctcagccgcccactttgagacttaatcctatggcaccacctagtagacagggtagtgcattacataaaattattgtcaagaaaattatagtcaagaaagcaaggagatactgaggtgtggcaattcccagtaatgttggaactgatgccacctggagaaggggcccaagagggagagcctcccacagttgaggccagatacaagtctttttctataaaaatgctaaaagataggaaagacggagtcaaacagtatggacccaactccccttacatgaggacattattagattccattgctcatggacatagactcattccttatgattgggagattctggcaaaatcgtctttctcaccctctcaatttgtacaatttaagacttggtggattgataggacacaagaacaggtccgaagaaatagggctgccaatcctccagttaacatagatgcagatcaactattaggaacaggtcacaattggagcactgttaatcaacaagcagtaatgcaaaatgaggccattgagcaagttagagctatttgccttagagactgggaaaaattccaagacccaggaaccgcctacccctcatttaatacaataagacaaggctctaaagagccctaccctgatttgtggcaaggctccaagatgctgctcaaaagtcaattgccgatgaaaatgcccaaaaagtcatagtggaattgatggcatacgaaaacgccaatcctgagtgtcaatcagccattaagccattaaaaggaaagtttcccgccgaatcagatgtaatctcagactatgtaaaagtctgtcatggaattggaggagctatgcataaagctatgcttatggctcaagcaatagcgggagttgctttaggagggcaagttagaacatttggagggaaatgttataattgtggtcaaattggccatttaaaaaagaattgcccagtctcaaataaacagaatataactattcaagctactacaacaacaggtaaagagccacctgacttatgtccaagatgtaaaaaaggaaaacactgggctagtcaatgtcgttctaaatttgatagaaatgggcacgagcaaaggggccagcctcaggccctgcaacaaactggggcattcccaattcagccctttgttcctcagggttttcagggacaacaacacccactgtcccaagcacctcaggaaataagccagttaccacaatacaacaattgtcccctgccacaagcagcagtgcagcagtagatttatgtactatgcaagcagtttgtctgtttccagggtagcccccacaaaaaatccccacaggggtatatggcccactgcctgaggggactataggactaatcttaggaagatcaagtctaaatctaaagggcattcaaattcatactggtatggttgattcagactataaaggcaaaattcaattggttattagctcttcaattccttggagtgctagtccaggagacaggaatgctcatttattactcctgccttatgttaaggttggaaatagtgagataaaaagaacagcagggtttggaaacacagatctgacaggaaaggctgcatattgggcaagtcgggtctcagagaacagacctgtgcgtaaggccattattcaaggaaaacagtttgaagggttagtaaacactggagcagatgtctccatcattgctttaaatcagtggccaaaaaattggcctaaacaaaaggctgttacaggacttgtcagcataggcacagcctcagaagtgtatcacagtactatgattttacattgttcagggccagataatcaagaaagtacttcacatgttaaaaaaacatttattatcttgtctcgctgtaatgggagttccagaaaaaatcaaaactgacaatggccgggtgtggtggctcacgcctgtaatcccagcactttgggaggctgaggcaggcagatcacctgaggtcaggagttcgagaccagcctcaacgtggagaaaccccgtctctactaaaaatacaaaattagacaggcatggtggtgcatgcctgtaatcctagctactcaggaggctgaggcaggagaattgcttgaacctgggaggtggaggttgcagtgagccaagctcgcgccattgcactccagcctgggcaacaagagcgaaactccatctcaaaaaaaaaaaaaaaaaaaaaaaaaaaaactgacaatggaccaggatattgtagtaaagctttccaaaaattcttaaatcagtggaaaatttcacatacaacaagaattctctataattcccaaggacagcccatagttgaaagaactaatagaacactcaaaactcaattagttaaacaaaaagaagggggagacagtaaggaatgtaccactcctcagatgcaacttaatctagcactctatactttaaattttttaaacatttatagaaatcagactactacttctgcaggacaacatcttactggtaaaaagaacagcccacatgaagaaaaactgatttggtggaaagataataaacataagacatgggaaatagggaaggtggtgatgtgggggagaggttttgcttgtatttcaccaggagaaaatcagcttcctgtttggatacccactagacatttgaagttctacaatgaacccatcagagatgcaaagaaaatcgcctccacggagatggaaacacc

SEQ ID NO: 242 - DNA, 5641 bp, Homo sapiens
tcaggcctctgagcccaagccaagccatcacatgccctgtgacttacatgtatatgcccagatggcctgaagtaactgaagaatcacaaacaaagtgaatatgccctgccccaccttaactgatgacattccaccacaaaagaagtgtaaatggccagtccttgccttaagtgaggacattaccttgtgaaagtccttttcctagctcaccctggctcaaaaagcacccccactgagcaccttgagacccccactcctgcccaccagagaacaaaccccctttgactgtaattttcctttacctacccaaatcctataaaacggccccacccttatctcccttcgctgactctcttttcggactcagcccacctgcacccaggtgaaataaacagctttactgctcacacaaagcctgtttggtggtctcttcacacggacgcgcatgaaatttggtgccatgactcggatcaggggacctcccttgggagatcaatcccccgtcctcttgttctttgctccatgagaaagatccacctatgacctcaggtcctcagaccgaccagcccaagaaacatctcaccaatttcaaatccggtaagtggcctctttttactctcttctccaacctccctcactatccctcaacctctttctcctttcaatcttggtgccacacttcaatctctcccttctcttaatttcaattcctttcaattcctttggtagagacaaaggagacgcattttatccgtggacccaaaactccggcgccggtcacggactgggaaggcagccttcccttggtgtttaatctttgcagggacgcctgcctcggtccttcacccttagcggcaagtcctgctttcctggggcaggggcaagtacccctcaaccccttcttcaccctcagcggcaagtcctgctttcctggggcaggggcaagtacccctcaaccccttctccttcaccctcagcggcaagtcccgctttcctagggggcaagaaccccccaatcgcttatttccacaccccaacctcttatctctgcgccccaatcccttatttccgtgccccaaccccttctctgcttttctggagggcaagaaccccccacccctactccatgtctctactcttttgtctgggcttgcctccttcactatgggcaagcttccaccttccattcctccttcttctcccttagcctgtgttctcaaaaacttaaaacctcttcaactcacacctgacctaaaacctaaatgccttattttcttctgcaatgccacttgaccccaatacaaactcgacagtagttccaaatagccagaaaatggcactttcaatttttccatcctgcaagatctaaataattcttgtcgtaaaatgggcaaatgttctgaggtgcctgacgtccaggcattcttttacacatctgtcccttcctagtctctgtgcccagtgcaactcgtcccaaatcttccttctttccctcccgcctgtcccctcagtcccaaccccaagcgtcgctgagtctttctaatcttccttttctacagacccatctgacctctcctctcctcgccagctcaagctaagtcccaattcttcctcagcctccgctcctgcaccctgtaatctttttatcgcctcccctcctcacacctggtctggcttacagtttcattccgtgactagccctcccccacctgcccagcaatttacccttaaaaaggtggctggagccaaaggcatagtcaagtttaacgctcctttttctttatcccaaatcagatagcgtttaggctctttttcatcaaatataaaaacccagcccagttcatggctagtttggcagcaaccctgagaggctttacagccctaaaccctaaaaggtcaaaaggccgtcttattctcaatatacattttattacccaatctgctcccgacattaaataaaactccaaaaattaaattccggccctcaaaccccacacaggatttaatgaacctcgccttcaaggtgtacaataatagaaaaaagttgcaattccttgcctccactgtgagacaaaccccagccacatctccagcacacaagaacttccaaacgcctgaaccgcagcggccaggcgttcctccagaacctcctccaggagcttgctacaagtgccagaaatctgaccaccaggccaaggaatgcccgcagcccaggattcctcctaagccatgtcccatctgtgcaggaccccactggaaatcggactgttcaactcacctggcagccactcccagcgcccctggaactctggcccaaggttctctgactgactccttctcggcttagcggctgaagactgatgctgcccgatcacctcagaagccccctagaccatcacggacgccgagcttcaagtaactctcacagtggagggaagtccgtccccttctttatcaatacggaggctacccactccacattaccttcttttcaagggcctgtttccctcgcctccataactgttgtgggtattgatgaccaggcttctaaacctcttaaaactccccaactctggtgccaacatagacaatactcttttaagcactcctttttagttatccccacctgcccagttcccttattaggccaaaacactttaactaaattatctgcttccatgactattcctagactacagctatatctcattgctgcccttcttcccaatccaaagcctcctttgcgtcctcctcttgtatcccccccaccttaacccacaagtataagatacctctactccctccttggtgagactgatcacgcaccccttaccatctcattaaaacctaatcacccttaccccgctcaacgccaatatcccatcccgcagcacgctttaaaaagattaaagcttgttatcactcgcctgctacagcatggccttttaaagcctataaattctccttacaattcccccattttacctgtcctaaaaccagacaagccttacaagttagttcaggatctgcaccttatcaaccaaattgttttgcctatccaccccatggtgccaaacccatatactctccaatcctcaatacctgcctctactacccattattctgttctggatctcaaacatgctttctttactattgctttgcacccttcatcccagcctctctttgctttcacttggactgaccctgacacccatcaagctcagcaaattacctaggctgtactgccgcagagcttcacagacagcccccattacttcagtcaagcccaaatttcttcctcatctgttacctatctcggcataattctcataaaagcacacgtgctctccctgccaatcgtgttcgactgatctctcaaacccaagcatcttctacaaaacaacaactcctttccttcctaggcatggttagcgcggtcagaattcttacacaagagccaggaccacaccctgtagcctttctgtccgaacaacttgaccttactgttttagcctagccctcatgtctgcgtgcagcggctgctgctgctttaatacttttagaggccctcaaaaatcacaaactatgctcaactcactctctacagttctcataacttccaaaatctattttcttcctcatacctgacgcaaatactttctgcttcccggctccttcagctgtactcactctttgttgagtctcccacaattaccgttgttcctggcccagacttcaatctggcctcccacattattcctgataccacacctgacccccatgactatctctctgatccacctgacattcaccccatttccccaaatttccttctttcctgttcctcacgctgatcacgcttgatttattgatggcggttccaccaggcctaatcgccacacaccagcaaaggcaggttatgctatagtacaagccactagcccgcctcttagaacctctcatttcctttccatcgtggaaatctatcctcaaggaaataacttctcagtgttccatctgctattctactactcctcagggattattcaggccccctcccttccctgcacatcaagctcgaggatttgccccacccaggactggcaaattagctttactcaacatgccctgagtcagataactaaaatatctcttagtctaggtagatactttcactggataggtagaggcctttcctacagggtctgggaaggccaccgcagtcatttcttcccttctgtcagacataattcctcagtttagccttcccacctcaatacagtctgacaacagatgagcctttattagtcaaatcagccaagcaggttttcaggctcttagtattcagtgaaacctttacatcccttacggtcctccgtcttcaagaaaagtagaatggactaaaggtcttttaaaaacacacctcaccaagctcagccaccaacttaaaaaggactggacaatacttttaccactttcccttctcagaattcaggcctgtcctcagaatgctacagggtacagcccatttaagctcctgtatagatgctcctttttattaggccccagcctcattccagacaccagaccaacttagactgtgccccaaaaaacttgtcatccctactatcttctgtctagtcatactcctgttcaccgttctcaactactcatacatgccctgttcttgtttacactgccggtttacactgtttttccaagccatcacagctgatatctcctggtgctatccccaaactgccactcttaactcttgaagtaaataaataatctctgctggcaggactatgctgaatctccttaggcactctctaatcagatatcctgagtcatcccaattcttagaccttttatatctgttttactccttctcttattccatttagtttctcaattcatccaaaaccatatccaggccatcaccagtcattctatatgacaaatgtttcttctaacatccccacaatctcaccccttaccacaagacctcccttcagcttaatctctcccactctaggttcccacgcctcccctaatcccgcttgaagcagccctgagaaacatcacccattctctctccataccaccccccaaaaatttccgccgctccaacacttcaacactattgtgttttatttttcttattaatataagaagtcaggaatatcaggcctctgagcccaagccaagccatcgcatcccctgtgacttgcacgtatatgcccagatggcctgaagtaactgaagaatcacaaaagaagtgaatatgccctgccccaccttaactgatgacattccaccacaaaagaagtgtaaatgcccgggtcttgccttaagtgatgaccttaccttgtgaaagtccttttcctagctcatcctggctcaaaaatcacccccactgagcaccttgagacccccactcctgcccgccagagaacaaacccccttggactgtaattttcctttacctacccaaatcctataaaagggctccacccttatctcccttcactgactctcttttcggactcagcccacctgcacccaggtgaaataaacagctttactgctcacacaaagcctgtttggtggtctcttcacacggacgcgcatgaaa

SEQ ID NO: 243 - DNA, 716 bp, Homo sapiens
gagagacaggactagctagatttcctaggccaactaagaattcgtatgccttgctggaaaaggtgaccacacctacctttaagcatggggcctgtaactcagctcacacccaacccgtcaggtagtaaagaggtctcactaaaatacaaattaggccaatgcacgaggtaaagaaatagtcaaatcatatatcacctgagagcacagggggagggacaatgatcggaatataaactcaggcattggaccagggaggagcaacccccttttggtcccttcccattttatgggagctctcttcactctatttaaatcctgcaactgcacactcttctggtccgtgtttttttatgggtcgagctgagctttcactcaccatccaccactgctgtttgctgccatcacagacccacggctgacttccacccctccagatccagcagggtgtccactgcacttctgatccagccagacagtgcccattgctgctcccaattgggctagaggctcgccattgttcctgagcaggctaagtgcctggggttcatcctaatcgagctgaatagagctgtaacattcaccgcatggcccaagattccattccttggaatccataaggccaagaaccccgggttagagaacaagaggcttgctgccatcttggaagcagcccaccaccatcttgggagctctaagaacaaggacccctggtaaca

SEQ ID NO: 244 - DNA, 1314 bp, Homo sapiens
gtggggaaaagaaagagagatcggactgttactgtgtctatgtagaaaaggaagacataagaaactccattttgatctgtaccatggctgggcacggtggctcacgcctgtaatcccagcactttgggaggccgaggcgcgcggatcacaaggtcaggagattgagaccatcctggctgacatggtgaaaccccgtctctaccaaaaatacaaaaaattagccaggtgtggtggcacgtgcctgtagtaccagctactcaggaggctgaggcaagagaatcgcttgaacccgagaggcgaaggttgcagcgagccaagattgcaccactgcactccagcctgggtgacagagcgagactccatctcaaaaacaaaaacaaacaaacaaaaaaagatctgtaccctgaacaattgttttgccttgagatgctgttaatctgtaactttagccccaaccctgtgctcacagaaacatgtgttgtatggtatcaaggtttaagggatctagggctgtgcaggatgtgccttgttaacaacatgtttacaggcagtttgcttggtaaaagtcatcaccattctccattctcgattaaccaggggcacaatgccctgcggaaagctgcagggacctctacccaggaaagccgggtattgtccaaggtttctccccaatgagacagcctgagatatggcctcgtgggacgagaaagacctgaccgtcccccagcccgacacccatgaagggtctgtgctgaggaggatcagtaaaagaggaaggcctcttgcggttgaggtaagaggaaggcctctgcctcctgcatgcccctggaaacggaatgtctcggtataaaacccgattgtacatttgttctattctgagataggagaaaaccaccctgtggctggaggcgagatatgctggtggcaatgctgctctgttattctttactacactgagatgcttgggtggagagaagcataaatctggcctatgtgcacatccaggcatagtaccttcccttgaacttatttgtgacacagattcctttgctcacgttttcttgctgaccttctccccactatcaccctgttctcctgccgcattccccttgctgagacagtgcaaatagtaaacaataaatactgagggaactcacagactggtgccggtgcaggtcctccatatgctaagtgttggtctcctgggcccactgttctttctctatactttgtctctgtgtcttatttcttttctcagtctctcgtcccacctgacgagaaacacccacaggtgtggaggggcaggccaccctt

SEQ ID NO: 245 - DNA, 2363 bp, Homo sapiens
tgcggtcagaattcttacacaagagccaggaccgcaccctgtagcctttctctgcaaacaacttgaccttactgttttagcctagccctcatgtctgtgtgcggcggctgccgctgctttaatacttttagaggccctcaaaatcacaaactatgctcaactcactctctacagttctcataacttccaaaatctgttttcttcctcatacctgacgcatgtactttctgcttccccgctccttcagctatactcactctttgttgagtctcccacaattaccattgttcctggcccggacttcaatccggcctcccacattatacctgataccacacctgaccctcatgactgtatctctcggatccacctgacattcaccccatttccccaaatttccttctttcctgttcctcaccctgatcacgcttgatttattgatggcggttccaccaggcctaatcgccacacaccggcaaaggcaggttatgctatagtacaagccactagcctgcctcttagaacctctcatttcctttccatcatggaaatctatcctcaaggaaataacttctcagtgttccatctgctattctactactccagggattattcaggccccctcccttccctacacatcaagctcgaggatttgccccacccaggactggcaaattagctttactcaacatgcccgagtcaggaaactaaaatacctcttagtctaaatagacactttcactgaataagtaaaggcctttcctacagggtctgagaaggccaccgcagtcatttcttcccttctgtcagacataattcctcagtttagccttcccacctcaatacagtctgataacagacgagcctttattagtcaaatcagccagcagtttttcagactcttagtattcagtgaaacctttatatcccttatggtcctccgccttcaagaaaagtagaatagactaaaggtcttttaaaaacacacctcaccaagctcagccaccaactgaaaaaggactggacaatacttttaccactttcccttctcagaattcaggcctgttctcggaatgctacagggtacggccgatttaagctcctgtatagacgctcttttttattaggccccagtctcattccagacacaagaccaacttagactgtgcctcaaaaaaaaaaaaaaaaaaaaaaaaaaaaaacttgtcatccctactattttctgtctagtcatactcctattcaccgttctcaactactcaaacatgccctgctcttgtttacactgccagtttacactgtttttccaagccatcacagctgatatctcctggtgctatccccaaactgccactcttaactcttgaagtaaataaataatctttgctggcaggactatgctgaatctccttaggcactctctaatcagatatcctgagtcgtcccaattcttagaccttttatacctgtttttctccttctgttattccatttagtttttcaattcatacaaaactgtatccaggccatcaccaatcattctataagacaaatgtttcttctaacatccccacaatatcaccccttaccacaagacctcccttcagcttaatctctcccactctaggttcccacgctgcccctaatcccgcttgaagcagccctgagaaacatcgcccattctctctccataccaccccccaaaagttttcgccgccccaacacttcaacactattttgttttatttttcttattaatataagaaggcaggaatgtcaggcctctgagcccaagccaagccatcgcatcccctgtgacttgcacatataagcccagatggcttgaagtaactgaagaatcacaaaagaagtgaatatgccctgccccaccttaactgatgacattccaccacaaaagaagtgtaaatggccggtccttgccttaactgatgacattaccttgtaaaagtccttttcctggctcatcctggctcaaaaagcacccccactgagcatcttgcgacccccactcctgcccaccagagaacaaacccccttcgactgtaattttcctttacctacccaaatcctataaaacggccccacccttatctccctttgctgactctcttttcggactcagcccgcctgcacccaggtgaaataaacagccatgttgctcacacaaagcctgtttggtgttctcttcacacggacgtgcatgaaatttggtgccgttttttgttgctcacacaaagcctgtttggtggtctcttcacacggacgcgcatgaaatttggtgccgttttttgttgctcacacaaagcctgtttggtggtctcttcacacggacgcgcatgaaa

SEQ ID NO: 246 - DNA, 6005 bp, Homo sapiens
gtcaggcctctgagcccaagctaacccatcatatcccctgtgacctgcacatatagatccagatggcctgaagcaagtgaaggatcacaaaagaagtgaaaatggctggttcctgccttaactgatgacattaccttgtgaaattccttctcctggctcagcagctcccccattgagcaccttgtaacccccgcccctgccaccagagaacaacccctttgactgtaattttccactacctacccaaatcctataaaacggccccacccctatctccctttgctgactctctttttggactcagcccgctggcacccaggtgattaaaaagctttattgctcacacaaagcctgtttggtggtctcttcacacggacgcacatgacatttggtgccaaagacctgggacaggaggactccttccagagacttgtcccctgtcctcgtcctcactccgtgaggagatccacccacgacctcaggtcctcagaccaaccagcccaaggaacatctcaccaatttcaaatcggttaagcggtcttttcactctcttctccagcctctcttgctacccttcaatctccctctctcgctatccttcaatctccctgtccttccaattccagttttttttcctctctagtagagacaaaggagacacatttcatccgtggacccaaaactctggtgctggtcacggacttgggaagacagccttcccttggtgtttaatcactgtggggacgcctgcctgattattcacccacactccattgttgcctgatcaccatggggatgcctgccttcattcacccacattcacttggtggcatgtcaatggtgggaatgcctgctttggctgctcacccacactgcagcccagggctgctcaccaccccccttctccatgtctctaccctctcttttctctgggcttgcctccttcactatgggcaaccttccaccctctattcccccttcttctcccttagcttgtgttctcaaaaacttaaaatctcttcaactcacacctgatctaaaacctaaacaccttgttttcttctgcaatgccacttgaccccaatacaaactcgacaattgttccaaatagccagaaaatccactttcaatttctccatcctacatgatctagatagttcttgtcataaaatgagcaaatggtctgaggtgcctgacgtccaggcattcttttacacatcagtccctccctagtctctgttcctaatgcaactcatcccaaatcttccttctttccctctcgcccgtcccctcagtcccaaccccaagcgtcactgagtcttttcaatcttccttttctaccaaccaatctgatctctcccctcttccccagagtgctcctcctcagtttgctccccgccaggctgaatcaggctccaattcttcctcggcctccactccccgacactataatccttctatcacctcccttccttacacctgctctggcttacagtttcattctgagactagccctcccccacctgcccaacaatttcctcttaaagaggtggctggagctaaaggcatagtcaaggttaatgctccttttctttatctgacctctcccaaagcagttagtgtttaggctctttttcatcaaatgtaaaaatccagcccagtttatggcttgtttagcagcaaacttgagaccctttaccaccctagaccctaaaaggtcagaaagccgtcttattctcaataagcattttattacccaatccgctcccgacattagaaaaagctccaaaaattagattccggccctcaaaccccacaacaggacttaactaacttcaccttcaaggcatacaataatagagttagaggcggccaagtagcaacatatttctgagttgcaattccttgcctccactgtgagagaaaccccagccacatctccagcacacaagaacttcaaaacgcctaagccacagtggtcaggcattctttcaggacctcctcccccaggatcttgcttcaagtgccggaaatctggccactgggccaaggaatgcccgcagcccgggatacctcctaagccatgtcccatctgtgcagaaccccactggaaatcggacagtccaactcacccatcagtcactcccagagcccctggaactctggcccaaggctctcggattgacgccttcccagattttctcagcttagcggctgaagactgacactgcccgattgcctcggaagtctcctggaagcctcctggaccatcacatatgctttgggtaactcttacattgagaggtacatctgtcaccttcttaatcaatatggaggctacccactccacattaccttcttttcaagggcgtgtttcccttgcctccataactgttgtgggtactgacgtctgggcttctaaatctcttaaaactccccaactctgatgccaacttggacaatattcttttatgcactcctttttagttatccccaccttcccagctcccttattagactgacacatcttaagcaaattatctgcttccctgatgccacccttcttcccaacccaaagcctccttcacatcttcctctcatatccccctacttctactacctccctggcaactgatcacatgtccattactatcccattaaaccctaatcaccattaccttgctcaacaccagtatcctatcccacaacaggctttaaggggattaaagcctgttatcactcacctgctacagcatgggcttctaaaacttataaactctccttacaattcccccattttacctattcaaaaaccagacaagtcttacaggttagttcaagatctgcgccttatcaaccaaactgttttgcctatccaccctctggtgcccaacccgtacactcttttgccctcaataccttcctccacaactcactattccattcttgatcttaacgatggttttttcactattccactgcacccctcatcccagcctctctttgcctttaccctgacacccatcagtccctgcaaattacctgggctgtactgctgcaaggcttcagggacagccctcattacttcagccaagctctttctcatgatttactttctttccactcctccacttctcaccttattcaatatgttgatgacctactttgtagccctgcctttgaatcttctcaaaaagacaccctcctgctccttcaacatttattctccatgggatatcaagtatctccttccaaagctcaaatttcttctccatccattacctaacttggcatagttcttcatgaaaacccacgtgctctccctgctgatcatgaccaactgatctctcagaccccaaccccttctacaaaacaacagctcctttccttcctgggcatgattggatactttcacctttggatacctgcttttgccatcctaacaaaaccatcacataaactcacaaaaggaaatttagctgaccccatagatcctaaatcctttgcccactcctctttccgttccttgaagacagctttagagactgctcccacactagctctccctgactcatcccaacccttttcattacacacagccaaagtgcagggctgtgcagttggaattcttacacaaggaccaggaccacaccttgtagcctttttgtccaaacaacttgaccttactgttttaggctggccatcatgcctccgtgcggcagctgctactgccataacacttttagaggccctcaaaatcacaaactattctcaacacactctctacaattctcataacttccaaaatctattttcttcctcacacctggtgcgtatgctttctgctacccggctccttcagctatactcaccctttgttgagtctcccacaattactattgttcctggcctggacttcaatccagcctcccacattattctgaataccacacttgacccccatgactgtatctctctgatccacttgacattcattccatttccccatatttccttctttcctgttcctcaccctgatcacacttggtttatcgatggcagttccaccaggccaaatcaccactcaccagcaaaggcaggctatgctatagtatcttccacatctatcattgaggctaccgctctgcccccctccactccctctccgcaagccgaactcattgccttaactagagccctcactcttgcaaagggactacacatcagtatttatactgactctgaatattccgtccatatcctgcactaccatgctgttatatgggcagaaagaggttgcctcactatgcaaaggtcctccatcattaatgcctctttaatgaaaactcttctcaaggctgctttacttccaaaggaagctggagtcatatactgcaagggccatcaaaaggcatcagatcccatcgctcaggacagtgcttaggctgataaggtagctaaagaagcagctagtgttccaacttctgtccttcagtgccagtttttctctttctcactggtcactcccacctattcccccactgaaacgttcacctatcaatctcttcccacacaaggcaaatggttcttggaccaaggaaaatatctccttccagcctcacaggcccattctattctgtcgtcatttcaaaacctcttccatttaggttacaagccactagcccgcctcttagaacctctcatttgctttccatcatggaaatctatcctcaaggaaatcacttctcagtgttccatctgctcttctactactcctcagggattactcaggccccctcccttccctacacatcaggctcagggatttgcccctgcccaggactggcaaattgactttactcacatgccatgagtcaggaaactgaaatacctcttggtctgggtagacactttcactggatgggtaaaggcctttccctcagggtctgagaagtccactgcggtcatttcttcccttctgtcagacataattcttcagtttgggcttcccacctctatacagtccaataacggaccggcctttattagtcaaatcacccaagcagtttctcagtctcttggtattcagtagaaccttcataccccttaccaacctcaatctttaggaaagatagaacggactaatgatcttttaaaagcacacctcaccaagctcagcctccaacttaaaaaggaggactctgtcaaggatagagcccaaaaactcaccaaccaagcaagtaattacactgaaccccttggacactctctaattggatgtcctgggtcctcccaattcttagtcctttaatacctgttttcctctttctccttgtgtcttctgtctagtttctcaattcatacaaaactgtatccaggccatcaccaaccattctatacaaccaatgtcacttctaacaaccccacaatatcaccccttaccacaaaatcttccttcagctaaatctctcccactctaggctcccacattgcccctaatcccactcgaagctgccctgagaaacattgaccattatctctccataccacccccccaaaatttttgctgctctaacacttcaacattagtttatgttatttttcttattaatataagaagacaggaatgtcaggcctctgagcccaagctaagccatcatatcccctgtgacctgcacatatagaatcagatggcctgaagcaagtgaagaatcaccaaagaagtgaaaatggcctgttcctgccttaactgatgactttaccttgtgaaattacttcccctggctcagaagctcccccattgagcaccttgtgacccctgcccctgtccgccagagaacaacccttttgactgtaattttccactacctacccaaatcctataaaatggccccacacctatcttccttcactgactctctttttgaactcagcctgcctgcacctaggtgattaaaaagctttattgctcacacaaagcctgtttggtagtcacttcacacaga

SEQ ID NO: 247 - DNA, 698 bp, Homo sapiens
ttacagtaggtagctaatcaggaatgagcaggtcaggagagggcctccctgaccccatcaggaatgttaggcgaccatcaggtgattgtcgggaagttgttacactgcgtctctaaaataataattggtcacagccagtccctgagaaaggcggtctcccaataaatagatacaactgaaacgggtgatcaacagcttcctgataagatctcaggagttgggcgggtggcctcaagcagacacattaagaggcaaaatggcagagtttaactggtgtatggccttccagggacattcgattggtaagggaagaatgcctcaagtgagcatgtgtacaactccagtagacacactgtacatgctcacctcccaagcactagcaggccactgcacatatggacaccacgcctcctcccaaggaaagaatcaggggagaagagatgcaagaccctggaagtatgtcaacatataaaaccccaagtcaaacggtcaaaccatgcacttgatctctcaagtcaccttcgtggccctcttccaagtatactttacttcctttcattcctgttctaaagctttttagtaaactcactcctgctctaaaacttgccgcagtttctctttctgccttacgcccctcaattgaatttgtttcttctgagaaggcaagaattgaggttgcttcagacccttacagattt

SEQ ID NO: 248 - DNA, 668 bp, Homo sapiens
ttaccataggtagttaggcagacatgagcagggaaggagagggccctcttcaccaggaatgtcaggcgaccataaggtgatagtgaggtggttgttaaactgtctctaaaataataattggttgcagccagcgccagggaaacgcagtctcccaatagatagaaaacacctgaaactgatgatcagcagcttcctgattagatggcaggagttgggtgagtgaactcaagcatgcacactaagaggcaaaatggtggaattaactggtacctcaccttccttagggaatactcaaccggtaagggaaaaatgtttcaaggcggcctgaatacaactttagtaaacacactgcacacgtggcccctcctaagtgctggcaggccaccccaagggaaggatcaggggagaagggcacaatcaccccagaagcataaaaacccaagtcaacggtcaaaccttgcacttgatctctcaagtcacccgcttgcccctcttccaagtgtacttcacttcctttcattcttgctctaaaacttcttaataaactttcactccttcccttaagcttgcctcagtttctccctctgccttattccctttggttgaattctttcttctgaaggaggtaagaattgaggttgctgcagtcttgtgtggattcaccactg

SEQ ID NO: 249 - DNA, 4136 bp, Homo sapiens
gtcaggcctctgagcccaagctaagccatcatatcccctgtgacttgcatgtatacatccagatggcctgaagtaactgaagaataacaaaagaagtgatgtttaaatggcctgttcctgccttaactaatgacattccaccacaaaagaagtgaaaatggccggtgcttgcccttaaatgatgacattaccttgtgaaattccttctcctggctcatcctggctcaaaaagctcccccactgagcaccttgtgaccacactcctgccctccagagaacaacccccctttgcctgtaattttcctttacctaccgaaatcttacaaaatggccccacccctgtctcccttcgctgactctctttgcggactcagccagcctgcacccaggtgaaataaacagccttgttgctcacacaaagcctgtttaatggtctcttcacactggcgcgagcgaaattttggtgccaggactcggatcgggggcctcccttgggagatcaatcccctgtcctcctgctctttgtttcgtgagaaagatccacatacgaccttgggtcctcagaccgaccagcccaaggaacatctcaccaattttaaatctggtaagcggcctctttttactctcttctccaacctctctcactatccctcaacctctttctcctttcagtcttggtgccacacttcaatctctcccttgtcttaatttcagttcctttcattttctggtagagacaaaagagacacgttttatctgtggacccaaaactccagccctggtcacagacttgggaagacagtcttctcttggtgtttaatcacgcagggatggctgcctgattattcacccacgtttcagagttgtctgaccacacggggatgcctgccttggtccttcacccttagcagcaagtaccgcttctctggggggcaggaaccccccaaccccttctctccatgtctctaccccttctctgcttttctggagcgcaagaaacccccgaccccttctctccatgttgctaccccttctccgcttttctggggggcaagaaccccccaccccttctctccatgtctctactctctcttttctctgggcttgcctccttcactatgggcagccttccatcctccattcctccttcttctcccttagtctgtgctctcaagaacttaaaacctcttcacctcacacctgacctaaacctaaacgccttatttgcttctacaatgccgcttgaccccaatacagactcgacagtggttccaaatagccagaaaacagcacttttgatttttccatcttacaagatctagatatttcttaccataaaataggcaaatggtctgaggtgcctaacgtccaggcattcttttacacattgttccctccctagtctctgtccccagtgtgactcgtcccaaatcctccttctttccctcccgcctgtcctctcagtcccaaccccaagcatcactctttctaatcttccttttctacagacccatctgacatcccccctcctccccaggccgagccaagtcccaattcttcctcagcctctgctccccctaccctataatccttttatcacctcccctcctcacacccagtccagcttacagtttcgttccacgactagccatcccccacctgcccagcaatctcctcttaaaaaggtggctggaactaaaggcaaagtcaaggttaatgctcctttttctgtatctgacccctcccagaatcagttagtctttcagctcttttttcatcaaatatgaaaaacccagcccagttcatgacccgtttagcagtaaccctgagacactttacagccctagaccctgaaaggtcaaaataccatcttattctcaatatacattttattttattacccaatctgctcctgacattaaataaagctccaaaaattaaattccagccctcaaaccccacaacaggacttaattaatctcgccttcaaggtgtacaataatagaatagaggcggccaagtagcaacttgtttctgagttgcaattccttgcctccactgtgacagaaaccccagccacatctccaggacacaagaacttccaaacgcctaaaacgaagtggccaggcattcctccaggcccgcctgccccagaagcttgctacaagtgccagaaatctggccaccgggccaaagaatgcccacagcccgggattcctcctaagccacgtcccatctgtgtgggaccccactggaaatcggactgtccaactcacctggcagccactcccagagcccctggaactctggcccaaggctctctgactccttcccagatcttctcagcttagcagctgaagaccgacgctgcctaatcacctcggaaccttcccagaccatcacagatgctttaagtaacgttcacagtggaaggttaagtccgtccccttcttaatcaatacggaggctacccactccacattaccttcttttcaaagccctgtttcctttgcctccataactgctgtgggtattgacggccaggcttctaaacctcttaaaactccccaactctggtgccaacttagacaatactcttttaagcactccttttagttatccccacctgcgcagttcccttattaggctgagatattttaactaaatcatctgcttccctgactattcctgggctacagccacatctcattgccaccttttcccctagttcaaagcctccttcacatcctccccttgtatctccccaccttaaaccacaagtataggacgcctctactccctccttggcgacggatcatccaccccttaccatctcattaaaatctgatcacccttaccccactcaatgccaatatcccatctcgcagcacgctttaaaaggattaaagcctgttatcactcgcctgctacagcatggccttttaaagcctataaactctcgttacaattccccattttacctgtcctaaaaccagacaagccttacaggttagttcaggatctgcgccttatcaaccaaattgttttgcctttccaccccatggtgccaaacccatatactctcctatcctcaatacctccctctacaacccattatcctgttctggatctcaaacatgctttctttactattcctttgcacccttcatcccagcctctgttcactttcacttggactgaccctgacacccattaggctcagcaaattacctgggctgtactgccgcaaggtttcacagacagctcccattacttcagtcaagcccaaatttcttcctcatctgttacctatctcggcataattctcatgaaaacacatgtgctctccctgccagtcgtgtctgactgatctctcaaaccccaacaccttctacaaaacaacaactcgtttccttcctagacatggttggatactttcgactttagatacctggttttgccatcctaacaaagtgcaaaaagaaacctagctgaccccatagatcctaaatcctttccccactcctctttccatttcttgaagacagctttagagactgccccctagctctagagtccctagctctccctgactcatcccagcccttttcattacccacagctgaagtgcagggctgtgcagtaagaattcttacacaagaaccgggaccatgccctgtagcctttttatccgaacaacttgaccttactgttttccccagctctcaagtctatgtgcagcggccgctgccaccctaatacttttagaggcccttaaaatcaccaactatgctcaactcactctctaaagttctcataacttccaaaatctattttcttcctcacacctgacacatatactttctgctccccggctctttcagctgtactcactctttattgagtctcccacaattaccattgttcctggcccggacttcaatccggcctcccacattattcctgataccacacctgacccccatgactgtatctctctgatccacctgacattcaccccatttccccaaatttccttctttcctgttcctcaccctgatcacacttggtttattgatggcaggtccaccaggcctaattgccacacacaagcaaaggcaggctatgctacagca

SEQ ID NO: 250 - DNA, 981 bp, Homo sapiens
gtagagaaaagaaagagatcagactgttactgtgtctatgtagaaagggaagacataagaaactccattttgacctgtaccctgaacaagtgctttgccctgagatgctgttaatctgtaactttgccccaaccttgagctcacagaaacatgtgttgtatggaatcaaggtttaagggatctagggctgtgcaagatgtgccttgttaacaaaatgtttacaggcagtatgcttggtaaaagtcatcgccattctccagtctcgataaaccaggggcacaatgcactgcagaaagccgcagggacctctgcccaggaaagctgggtattgtccaaggtttctccccatgtgatagtctgaaatatggcctcgtgggatgggaaagacctgaccgtcccccagcccgtcacccgtgaagggtctgtgctgaggaggattagtaaaagaggaaggcctcttgcagttgagatagaggaaggccactgtctcctgtctgctcctgggaactgaatgtctcggtataaaacccaattgtacatttgttcaattctgagataggagaaaagcctccgtgtggcgggaggcgagacatgttggcagcaatgctgctctgttactctttactccactgagatgtttgggtggaaaaaagcataaatctggcctacatgcacatccaggcatagtaccttcccttgaacttatttgtggcacagattcctttgctcatgtgttttcttgttgacctcctccccattatcaccctgctctcctgcctcattcctcttgctgagacagtgaaaatagtagttaataaatactgagggaactcagagactggtgccagtgcaggtcctccgaatgctgagcgccggtcccctgcgcccacttttctttctctatactttgtctctgtgtcttatttcttttctcagtctcttgtcctgcctgatgagaaatacccacaggtgtggaggggc

SEQ ID NO: 251 - DNA, 5902 bp, Homo sapiens
gagagacaggactagctggatttcctataagaattcctaagcctagctggggaaggtgaccacagccacctttaaacacagggcttgtaactcagctcacacctgaccaatcaggtagtaaagagggcttactaaaatacaaattaggctaagagcaggaggtaaagaaataatcaaatcatctattgcctgagagcataaggggaggcacaatgatcagcatataaacccagggcattcaagccggcagtggcaacctcctttgggtcccctcccattgtatgggagctctgttttcactctattaaatcttgcaactgcacactcttctggtccgtgtttgttccggctcgagctgagctttcatttgctaccaagcactgctgaatgctgctgtcacagacccactgttgaatcctacccctccggatctggcagggtgtctgctgtgcttctgatccagtgaggcacccattgctcctcccaatcaggctagaggttcaccattgttcctgtgcagctaagtgcccgggttcatcataattgagctgaacactagtcactgggttccacggttctcttccatgacccaaggcttctaatagagctataacactcactgcatggcccaaggttccattccttggaatccatgaggccaagaaccccaggtcagagaacaaaaggcttgctgccatcttgggagcagccgccaccatcttgagagcagctcaccaccatcttgggagctctaagaacaaagacctgctggtaacatctggttgcctgcacggggattctccaaagcgatgagtaatagaccacttttgcttgctattctgtcctattccttagaattggaggaaatactgggcacctgttggctggttaaaaatgattagcgtggccaccggacttaagactcaggtgtgaggcttcctggaaaaaggctttctaatgacccccaacccttctgggttgggagcattggtctgcctggaaccagcttccactttcacaatttcctgggggaagccaagggccaactagaggcagaaagctgtcgtcctgaactcccggcattggccggtcgagttcatggcacagccagaagtctctactcaatagttgcccatgaatgtgcccctacctctccttctgacccatacctcctgggtcctgaccaagactttcttgaaagtgtagccccaaaattctccttacctctgatccctgcctcctaggtactaatgcttcagactttcatttcctatcccaagtattagagcaagttgtatctccaaagggatctaaggaagctcaatgctgcgtcctcaggcatctaggctgtgaatccagtgagtctgcccctggtatccctcccaatttaggtatacagctcttgacatgggcagttatgtgggacccgttccccaccacccttgccagggccccaagtttgtaagtggctaggaggattgctctcccattgtgcaagatactctcctctcccaatttctacccagcttaccctccccctgcaatacaatctccaagccttggctccttggccagggccttagagctgatgacccagtactttaacaactggaattgggtctacaacaacataacagatcagggtgaaagcaaaatgagtaaattaaagggaaaagagagaaggcagagagagggagagagaagagagagaaaaagggagagagagaaaagagagagagaaagtcagagaaaagaaagaaagagagagaaaaaagggaaaaagagggaaagagagaaagatagaagtggtaaagaaaaaacagtgtgccctattcctttaaaagccaggctaactttaaaacctataattgataattgaaggtcttctccatgaccctataacactccaatactaccttgttgtcagtgtaaacaagggcatagcctgaaaacactgagaccacggacaacccttagccttcctatcaaaaatccttaacccagtaacccacggatggaccaaatgcattcaatctgtagcagcaactgctttgctaacagaagaaagtagaaaaataacttttagaggaaatctcattgtgagcacacctcaccagttcagagctatcctaagtcaaaaaaagcaaaaaggtagcttactaactcaaaaatcttaaagtatagggctcttctgttagaaaaaggtgatttaacactaaccactgataattcccttaacccagcagatttcataacaggggatttaaatcttaattattatgcaaaggtccgaccagacctaggaggaactcccttcaggacagggcaatagatggttcctcccgagtgattgagggaaaaaaacacaattggtattcagtaattgagggaaactctcgtaaaagcagagttaggaaaattgcttaataattggtctgctcaaacgtgcagaccaattttgcactcagccaagccttaaagtacttaaaaaacctgcaagcccatctttttctcctcgctctccttctcacaggaaaaaggcacataggataaaaagatccatctctcatatttcatacccaaaaggacttaatccagggcaacaaaaaatttaagactgataatcagggtgtatttctacaaaggaaaagaaggacaaaggccctagtgggcaaaaactctatctcagttctgactcaaaaggttgtctacaccctctctgaaatgaatttgcataagaactgttgtttatgggaatgcatcttgatggggcagctgggttcttatgaaatattcagaagcccagcccagctctagaactcacccctagcgcaaaggcaatgttgggcacgctggtaaaggacctctagaatccagcagcccagacccgtttctctgtggtcaagaaaggtgggaaaaggcgtgcaggactactacatcggtgagcgtaactaatccgataagcagaggtccatgggtggttatgcaccctggaaaggaataagcattaggaccatagaggacgctctaggactaatgctcattggaaaatgactagggttgccggcatccctatgttctttttccagatgggaaacatttctcccaaggcaaaaatgccactaagatgtattctggagaattcagcccagagtgcatatacctttttctctgtcagacttgaagcaaattaaaatagacctaggtaaattctcagatacccctgatggctatattgatgttttacaagggttaggacaaccctattatctgacatggagagacataatgttactgctagatcagacactaaccccaaatgagagaagtgccgccataactgcagtccgagagtttggtgatctctggtatctcagtcaggtcaatgataggaagataacagaggaaagagaacaattccccacaggccagcaggcagttcccagtgtagaccctcattgggacacagaatcagaacatggagattggtgccacagatatttgctaactgacgtgctagaaggactaaggaaaactaggaagaagcctaataaattagtcaatgatatccactataacacagggaaaggaagaaaatcctactgcctttctggagagactaagagaggcattgaggaagcatacctcactgtcacctgactctattgaaggccaactaaggttaaaggataagtttatcactcagtcagctgcagacattagaaaaaaacttcaaattccaccttaggcctggagcaaaacttagaaaccctattgaacttggcaacctcggttttttataatagagatcaggaggagcaggcagaacgggacaaacaggataagaaaaaggccaccactttagtcatggccctcaggcaagtggactttagaggctctggaacagggaaaggctaggcaaatcaaatgcctaatagggcttgcttccagtgaggtctacaaggacactttaaaaaagattgtccgaatagaaataagccaccccctcatccatgccccttatgtcaagggaatcactggaaggcccactgccccaggggacaaaggtcctctgagtcagaagccactaaccagataatccagcagcaggactgagggtgcctggggcaagcgccagcccatgccatcaccctcacagagccccaggtatgcttgaccattgagtgccagggggttaactctcttctggatactggtgtggccttgtcagtcttactctcctgtcccagacaactgtcttccagatctgtctctatctgaggggtcttaggacaggcagtcactagatacttctcccagccactaagttgtgactagggaacttcactcttttcacatgcctttctaattatgcctgaattccccactcctttgttagggagagacatcctagctaaagcaggggccattatacacctgagcataggagagggaacacaggttattgttccctacttgaggaaggaattagtcctgaagtctgggcaacagaaggacaatatggacaagcgaagaatgcccatcccattcaagttaaactaaaggattccacctcctttccctaccaaaggcagtacccacttagacatgaggcccagcaaggagtccaaaagattgttaaagacctaaaagcccaaggcttagtaaaaccatgcaatagtccctgcaatactccaattttaggagtacagaaacccaatggacagtggaagttagtgcaagatctcaggattatcagtaaggccgttgtacctctatacccagctctacctaacccttataccctgctttcccaaataccaggggaagcagagtggtttatggtcccggaccttaaagatgcctttttctgcatccatgtatctttaacctccttgttaagtttgtctcttccagaatcgaagctgtaaaactacaaatcattcttcaaatggagccccagatgcagtccatgactaagatgtactgtggacccctggaccagcctgctagcccatgctccaatgttgatgacatcgaaggtacccctcctggggaaatatcaactgcatgacccctactacaccccaattcagcaggaagcagttagcgcagtcattggccaacctccccaacaacacttgggttttcctgttgagagggggtactgagagacaggactagctggatttcctataagaattcctaagcctagctggggaaggtgaccgcacccacctttaaacacagggcttataacttagctcacacctgaccaatcaggtagtaaagagggctcaccaattagtctaagagcaggaggtaaagaaatagtgaaatcatctattgcctgagagcacaaggggagggacaatgatcgggatataaacccagggcattcgagccggcagtggcaaccccctttgggtcccctcccattgtatgagagctctgttgtcactccgttacatcttgcaactgcacactcttctgatccatgtttgttccagctcaagctgagcttttgctcaccatcaaccactgctgaatgccactgttgcagacccactgttgactccacccctccagatttggcagggtgtctgctgtgcttctgatccagtgaggcaccattgtgactcctgatcatactagaggcttaccattgttcctgtgcagctaagtgcccgggtccatcctaattgagccaaacattccacggttctcttccatgacccacagcttctaattgagctataacactcaccgcatgcccaaggttccattccttggaattcatgaggccaagaaccccaggtcagagaacaaaaggcttgctgccatcttgggtgtggcctgccaccaccttgggagctctaggagaaaagatccactggtgaca

SEQ ID NO: 252 - DNA, 2197 bp, Homo sapiens
tgcggtcagaattcttacacaagagccaggacaacaccctgtagcctttctgtccaaacaacttgaccttactgttttagcctagccctcatgtctgcgtgcagcagctgccgctgctttaatacttttagaggccctcaaaatcacaaactatgctcaactcactctacagttctcataacttccaaaatctattttcttcctcatacctgatgcatgtactttctgcttcccggctccttcagctatactcactctttgttgagtctcccacaattaccgttgttcctggcctggacttcaatcctgcctcccacattattccagataccacacctgacccccatgactgtatctctctgatccacctgacattcaccccatttccccaaatttccttctttcctgttcctcaccctgatcacgcttgatttattgatggcggttccaccaggcctaatcgccacacaccagcaaaggcaggttatgctatagtacaagccactagcctgcctcttagcacctctcatttcctttccatcgtggaaatctatcctcagggaaataacttctcagtgttccatctgctattctactactcctcagggattattcaggccccctcccttccctacacatcaagctccaggatttgcccccacccaggcctggcaaattagctttactcaacatgcccgagtcaggaaactaaaatacctgttagtctaaatagacactttcactgaataagtaaaggcctttcctacagggtctgagaaggccaccacagtcatttcttcacttctgtcagacataattcctcagtttacccctcccacctcaatacagtctgataacagacgagcctttattagtcaaatcagccaagcagtttttcaggctcttagtattcagtgaaatctttatatcccttatggtcctccgtcttcaagaaaagtagaatggactaaaggtcttttaaaaacacacctcaccaagctcagccaccaacttaaaaaggaccaatacttttaccactttcccttcccagaattcaggcctgtcctcggaatgctacagggtacagtccatttaagctcctgtatagacgctcctttttattaggccccagtctcattccagacaccagaccaacttggactgtacccccccgccaaaaaaaaacttgtcatccctactattttctgtctagtcatactcctattcaccgttctcaactactcatacatgccttgctcttgtttacactgccggtttacactgtttttccaagccatcacagctgatatctcctggtgctatccccaaactgccactcttaactcttgaagtaaataaataatctttgctggcaggactatgccgaatctccttaagcactctctaatcagatatcctgagtcgtaccaattcttagaccttttatacctgtttttctccttctgttattccatttagtttttcaattcatacaaaaccgtaccaggccatcacgaatcattctatatgacaaatgtttcttctaacatccccacaatatcacgccttaccacaagacctcccttcagcttaatctctcccactctaggttcccacactgcccctaatcccgcttgaagcagccctgagaaacatcgcccattctctctccataccacccccaaaaattttcgccaccccaacacttcaacactattttgttttatttttcttattaatataagaaggcaggaatgtcaggcctctgagcccaagccaagccatctcatcccctgtgacttgcccagatggcctgaagtaactgaagaatcacaaaagaagtgaatatgccctgccccaccttaactgatgacattccaccacaaaagaagtgtaaatggccggtccttgccttaactgatgacattacctcgtgaaagtccttttcctggctcatcctggctcagaaagcacccccactgagcaccttgtgacccccactcctgcccgccagagaacaaaccccctttgactgtaattttcctttacctacccaaatcctataaaacggccccacccttatctcccttcgctgactctttttggactcagcccacctgcacccaggtgaaataaacagccatgttgctcacacaaagcctgtttggggggtctcttcacacagacgcgcatgaaa

SEQ ID NO: 253 - DNA, 3490 bp, Homo sapiens
gtcaggcctctgagcccaagctaagccatcatatcccctgtgaccttcatgtacacatccagatggccggttcctgccttaactgatgacattatcttgtgaaattccttctccttgctcatcctggctcaaaagctcccctactgagcaccttgtgacccccactcctgcctgccagagaacaacccccctttttcctttacctacccaaatcctataaaatggccccaccccatctcccttcactgactctctttttggactcagcccacctgaacccaggtgaaataaacagctttattgctcacacaaagcctgtttggtggtctcttcacatggatgcatgtgaaatttggtgctgtgactcggattgggggacctcccttgggagatcaatcccctgtcctcctgctctttgctctgtgagaaagatccacctacgacctcaggtcctcagactgaccagcccaagaaacatctcaccaatttcaaatctgggaagcagcttctttttactctcttctccaacttccctcactatccttcaacctctttctcctttcaatcttggcaccacacttcaatttctcccttctcttaatttcaattcctttcattttccggtagagaccaaggagacacgttttatctgtggacccaaaactccggtgccggtcgcggactagggaaggcagccttcccttggtgtttaatcattgcagggacgcctctctgattattcacccaggtttcagaggtgtcataccacgcagggacacctgccttggtccttcacccttagcagcaagtcctgcttttctgggggaggcacaggaaacccaccctcttatctctgcaccccgatcccttatttccatgccccgccctcttatctctgtgccctgatcccttatttccacaacctgacctcctatctctgcaccccaaccctttatttctgtgccccaacccatttcctgcttttctggaaggcaagaccaccccaccccttctctttgtgtctctactctctcttttctctaggcttgcctccttcactatgggcaagcttccactctccattcccctttcttctccattagcctgtgttcttcaaaacctaaaacctcttcaactcacacctgacctaaaacctaaatgccttattttcttctacaatgccgcttgaccccaatacaaactcaacagtggttccaaatagccagaaaatggcactttcaatttttccatcctacaagatctagataattcttgtcataaatgggcaaatggtctgaggcgcctcacgtccaggcattcttttacacatcggtccctccctagtctctgttcccaaagcaactcatcccaaatcttctttctttccctcccacctctcccctcagtcccaaccccaagtgtctctgagtctttctaatcttccttttctacagacccatctgacctctccccttcttgccaggctgagctaggtcccaattcttcctcagcctctgctcctccaccctataatccttttatcacctcctctccttacactgggtctggcttacagtttcattccatgactagccctccccaacctgcccagcaatttactcttaaaaaggtggctggagctaaaggcatagtcaaggttaatgctcctttttctttatcccaaatcagataaggtttaggctcttttgcatcaaatataaaaatccgccccagttcatggctcgtttggcagcaaccctgagacgctttacagccctagaccctaaaaggtcaaaaggccgtcttattctcaatatacattttattacccaatctgctcccgacattaaataaaattccaaaaattaaattccggccctcaaaccccataacaggacttaattaacctcgccttcaaggtgtacaataatagagtacaggcagccaagtagcaacatatttctcagttgcaattccttgcctccactgtgagacaaaccccagccacatctccagcacacaagagcttccaaacgcctaaagcgcagtggccaggcgttcctccagaatcgcctctcccaggagcttgctacaagtgccagaaatctgaccaccaggccaaggaatgcctgcagcccgggattcctcctaagccatgtcccatctgtgcgggaccccactagaaatcggactgttcagctcacctggcagccactcccagagcccctggaactccagcccaaggctctctgactgactccttcccagatcttcttggcttagcagctgcagaccgacactgcccaatcgatcgcctcggaagcctacaggaccatcacagacgctctaggttactctcacagtggagtgtaagtccatccccttcttaatcaatacagaggctacccactccacattaccttcttttcaagggcctctttcccttgcctccataactgttgtgggtattgacagccagtcttctaaacctcttaaagctccccaactctggtgccaacttagacaatactcttttaagcactcctttttagttatccccacctgcccagttcccttattaggccgagacacttcaactaaattatctgcttccctgactattcccggactacagatacatctcattgccacccaccttaacccagaagtagaagatacctctactccctccttggcgacctatcatgcaccccttaccatctcagtaaaacctaatcatccttaccccgctcaatgccaatatctcatcccacagcatgctttgaaaggattaaagcctgttaccactcacctgctacagcatggccttttaaagcctataaactctccttacaattcccccatcttacctgtcctaaaaccagacaagccttacaagttagttcaggatctatgacttatcaatcaaattgttttgcctatccaccccaaggtgccaaacacatatactctcatatcctcaattcctccctccacaacccattattctgttctggatctcaaacatgctttctttactattcctttacacccttcatcccagccactcttcgctttcacttggactgaccctgacacccatcaggctcagcaaattacctgggctgtactgctgcaaagcttcacagacagcccccattacttcagtcaagcccaaatttcttccttatctgttacctatctccgcataattctcataaaaacacacgtgctctccctgccgatcgtgtgtgactaatctctcaaaccccaaccccttctacaaaacaacaactcctttccttcctgggcatggttggatactttcatctttagatatctggttttgccatcctaacaaaaccattatataaactcacaaaaggaaacctagctgaccccatagatcctaaatcctttcctcactcctctttctgttccttgaagacagctttaaagactgcccccatcctagtcttggttccctgac

SEQ ID NO: 254 - DNA, 285 bp, Homo sapiens
ctcgactgtaattttccattacctacccaaatcctataaaacggccccaccccatctcccttcactgaatctcttttcagactcagcccacctgcacccaggtgattaaaaagttttagtgctcacaggagaagggcaggaacccaggagacagagcttgcagtgagctgagatggcaccactgcactccagcctgggtgacagagcaagactccatctcaaaaaaaaactttagtgctcacaaaaagcctatttggtggtctcttcacactgacacacatgaaa

SEQ ID NO: 255 - DNA, 3943 bp, Homo sapiens
gtcaggcctctgagcccaagctaagccatcatatcccctgtgacctgcatgtacacatccagatggctggttcctgccttaactgatgacattccaccacaaaagaagtgaaaatggcctgttcctgccttaactgatgacattatcttgtgaaattccttctcctggctcatcctggctctaaagctcccctactgagcaccttgtaacctccactcctgcccaccagagaacaacccccctttttcgtctcctgcccaccagagaacaactcccctttttcgtttacctacccaaatcctataaaacggccccacccctatctccctttgctgactcccttttcagactcagccggcctgcacccaggtgaaataaacagccctgttgctcacacaaagcctgcttggtggtctcttcacacggatgtgcatgaaatttggtgccacgacttggattgggggacctcccttgggagatcaatcccctgtcctgctctttgctccgtgagaaagatccacctatgaacttccaccctccattcctccttcttctcccttagcctgtgttcttaagaacttaaaacctcttcaactctctcctgacctaaaatctaagcgtcttattttcttctgcaacactgcttggccccaatacaaacttgacaatggctctaaatggccagaaaacagcactttcgatttctccatcctacaagacctaaataatttttgtcaaaaaatgggcaaatggtctgaggtgccttacatccaggcatttttcccacttcattccctccctagtctctgttcccaatgcgattcctcccaaatcctccttctttccctcccgcctgtcccctctgtcccaaccccaagcatcgctgagtctttccagtcttccttttctacagacccatctgacctctccccttctccccaagctgctcattgccaggccgagctaagtcccaattctccctcagcttccgctcctccaccctataatccttctatcacttcccctcctcacacccggtccagcttacagtttagttccgtgactagctcttccccacctgcccaacaatttcctcttagagaggtggctagagctgaaggcatagtcagggtacatgtacctttttctctatcagacctctctcagatcagtcagcgtttaggccctttctcatcagaccccactaaatatatacaggaattccaatatctaactctgtcctacaatttaacctggagtgacttaaatgttatcctgatttctaccctctccccagatgaacaggaaagagttttttctctagcccaatctcatgctgataaccgctggcttcaagaaccagacctccaggaaggcattagagcagttcgctgagaggatccccaatggaactatcaggcagattccacaggtatagctaggcaagattacatgatttcctgcctagctgaagggcttaaaagggcagcttacaaagctgttaattatgacaagcttaaagaaactacccaaggtaaagacgaaaacccagcccagttcatggcccgcttagcagcaacccttagacgctttaccgccctagacccagaagggccagaaggcggtcttattcttaatatgcattttatcacccaatccactcctgacattgggaaaaaacttcaaaagttagaatctcgccctcaaaccccacaacaggaattaacctcgccttcaaggtgtacaataatggagaggaggtagccagacagcaatgcatttctgagttacagctgcttgcctccgctgtaagacagcccacaaccacgtctccagcatacaagaacttcagaacatccaagtcacagctcccaggggctccttcaaaacatcctcgtgggccttgcttcaaatgccaaaagcatagccactaggccaaggagtgcctgcagcctgggattcctcctaggatgtgccctgtctgtgcgggcccccactggaggtcagactgtctgactcacatcgccgccactcctaaagcccctggagcccaaacccaacgttccttggctgactccttcccagatctccttggctttgtggctgaagactgacgctgcccgatcgccttggaagccccctggaccatcacggacaccgagcttcaggtaactcttacagtggagggtaagtctgtcccctgtttaattgatatgggggctacccactccacattaccttcttttcaagggcctgtttcccttgcccccataacttttgtgggtattgacggccaagcttcaaaacaccttaaagctcccctactttggtgccaacttggacaaccttcttttaagcactcttttttagttatccccacctgcccagttcctttattaggccgagacattttaaccaaattatctgcttccctgactattcctggactacagccacatctcattgccactcttcttcccaacccaaagcttcctttgcgtcttcctcttgtatccccctaccttgacccacaagtatgggacatctttactccctccctggcaaccgatcacatgcccattaccatcccattaaaacctaatcacccttaccctgctcaacgccagtatcccatcccacagcacgctttaaagggattaaagcctgttatcactcgcctgttacagcatgggcttctaaaacctataaactctccttacaattcccccatttcacctgtccaaaaacctcacaagtcttacagattagttgaggatctgtgccttatcaaccaaattgttttgcttatctaccctgtggtgcccaacccatacactcttttgtcctcaatacattcctccacaactcactattccattcttgatcttaaagatgcttttttcactattctcctgtacccctcatcccagcctctctttgctttcacttggactgaccctgacacccatcagtcccagcagcttacctgggctgtgctgccgcagggtttcagggacagctctcattacttcagccaagctctttctcatgatttactttctttccacccctccgcttctcaccttattcaatatattgatgaccttcttctttgtagcccctcctttgaatcttctcaacaagacacccttctgctccttcagcatttattctccaaaggatattgggtgtccccctccaaagctcaaatttcttctccatccgtaatctacctcagcataattcttcataaaaatgcacatgctctccctgccaatcgtgtccgactgatctctcaaaccccaacaccttctacaaaacaacaactcctttccttcctaggcatggttggatactttcgattttggatgcctggtttcgccatcttaacaaaaccattatataaactcacaaaaggaaacctagctgaccccatagatcctaaatcctttctccattcctctttccgttccttgaagacagctttagagactgaagccaccctagctctccctgactcatcccaacccttttcattacccacagctgggctggaagtgcagggctgtgcagtcagaattgttacacaagggccgggaccacgccctgtagccttttgttccaaacaacttgaccttactgttttgcctagccctcaagtctgcatgcagcagccaccactgccctaatacttttagagacccttaaaatcacaaactatgctcaactcactcttctacagttctcataacttacaaaatgtattttcttcctcacacctgacacatatactttctgttcccgtgctccttcagctatactcactctttgttaagtctcccaccattaccattgttcctggcacagacttcaatccgccttccgcattattctggataccacacctgatcctcatgactgtatctctctgatccacctgaca

SEQ ID NO: 256 - DNA, 202 bp, Homo sapiens; identical to SEQ ID NO: 89

SEQ ID NO: 257 - DNA, 647 bp, Homo sapiens
ttagagtaggtagctagacagtaattagcagagtggagagcccccctaccaagaaatgtcaggcgaccatcaggtgatggtcaggtagttgttaaactgtctctctaaaataattgttggtcacagctggcaccaggaaaagacagcctcccaatagatagaaaacacctgaagctagtgatcagcagctgtgggctcaagtatgctcactgagaagcaaaatggcagcgtttaactggtatctgaccttccttgaggaacgcttgttaaggaaaaaatgcttcaagtgagcatgtgcataacttcagtagacacactgggcatgtggcctctcccaagtgctggcaggccaccatgcatgcgaacagcccgctccaagggaagaatcaagggagaagaaacgcaaaccccagaaccatgccaatgtataaaaccccaagtcaagggccagactgggcacttggatctctcaagttgcctgcgtggccctcttccaagtgtactttacttcctttcattcctgctctaaaatgtttgataaataaactctgactcctgctctaaaacttgcctccgtttctccttttgccttaaaactacttctgctccttggccaaattctttcctccagggaggcaagaattgag

SEQ ID NO: 258 - DNA, 5918 bp, Homo sapiens
gtcaggcctctgagcccaagccatcatatcccctgtgacctgcatgtatgcatccaggtggcctgaagtaactgaagaatcacaaaagaagtgaaaatggcctgttcctgccttaactgatgacattaccttgtgaaattccttctcctagctcatcctggctcaaaagctcccccactgagcaccttgtgacccccgcccctgcctaccagagaacaacctcctttgactgtaatttcccactacctacccaaatcctataaaacggccccacccctatctccctttgctgactctcctttcggactcagcccacctgcacccaggtgaaataagcagccttgttgctcacacaaaacctgtttggtggtctcttcacagcaacgcgaatgaaatttggtgccatcactcggatcaggggacctcccttgggagatcaatcccctgtcctcctgctctttgctccatgagaaagatccacctacgatctctgctcctcagaccaaccagcccaaggaacatctcaccaattttaaatcgggtaagcggcccctctttactctcttctccaacctctctcactatccctcaacctctttctcctttcaatcttggtgccatctttcaatctctcccttctcttaatttcagttcctttccttttctggtagagacaaaggagacatgttttatccatggacccaaaactccggtgccagtcacggactcaggaagacagtcttcctttgatgtttaatcacgtggggatacctgcctgattattcacccacatttcatcagtgtctgatcaccgcagggacgcctgccttggtcattcacccacattcccttgctggcaagtcaattgcagggatgcctgctttggctgctcacccacattgcagcccagggctgctcacccaaccccttcccgccatgtctctaccctctcttctctccactttcctggggggcaagcacccccccaccccttctctccatgtctctaccctgtcttttctctggacttgcctccttcactataggcaaccttccaccctccattcctccttcttctcccttagcctgtgttctcaagaacttaaaacctcttcaactcacacctgacctaaaacctaaatgcattattttcttctgccatgccacttgaccccagtacaaactccacagtggttccaaatagccagcaaatggcacttttgatttttccatcctacaagatctaaataattcttgttgtaaaatgggcaaatggtctgaggtgcctgacgtccaggcattcttttacatatcggtccctccctagtctctgttctcaatgcaacttgtcccaaatcttgcttctttccctcccgccttgtcccctcagtcccaaccccaagcatcgctgagtctttccaatcttccttttctacagacccatctgacctctcccctcctccccaggctgctcctcaccaggccgagctaggtcccaatttttcctcagcctccggtcccccaccctataatccttttatcacctcccctccttacacctggtctggcttacagtttccagtttcgttctgtgactagccctccccaacctgcccagcaatttcctcttaaaaaggtggctgtagctaaaggcatagtgaaggttaatcctcctttttctttatccgatctctcccaaatcagttaatgtttaggctctttttcatcaaatataaaaacccagcctagttcgtggcccgtttggcagcaaccctgagatgctttacagccctagaccctgaaaagtcagaaggccatcttattctcaatatgcattttattttatcacccaatctgctcccgacattaaataaagctccaaaaattaaattctggccctcaagccccacaacaggacttagttaaccttgccttcaaggtgtacaataatagagtagaggcagccaagtagcaatgtatttctgagttgcaattctttgcctccactgtgagacaaaccccagccacatctccagcacacaagaaatccaaacacctggatgaggttctggatgaaccgcagctgccaggggttcatccagaacctccttccccaggagcttgctatgagtgctagaaatctggccactgggccaaggaattcctgcagcctgggattcctcctaagccatgtcccatctgtgcaggatcccactgaaaattggactgttcaatttacctggcagccactctcagagcccctggaactctggctcaaggctctcttactccttcccagatcttctcagcttagcggctgaagactgatgctgccagatgactttggaagccccctggaccatcacagatgcccagctttggataactcttacagtggagggtaagtccgtcctcttcttaatcaatacagaggctacccaactccacattaccttctttcaagggcctgtttcccttgactccataactgttgtgggtattgatggccaggtttcttttttttttttttttttttttttgagatggagtctggctctgtcgcccaggctggaatgcagtggtgcaatctcggctcgctgcaagctccacctccggggttcacgccattctcctgcctcagcctcccgagtagctgggactacaggcccccgccactacgcccagctaattttttatatttttagtagagacggggtttcaccgtgttagccaggatggtctcaatctcctgacctcgtgatccacccgcctcggcctcccaaagtgctgggattacaggcatgagccaccgtgcccggccgatggccaggtttctaaacctcttaaaactccccaactctggtgccaacttggacaatattcttttatgcactcctttttagttatcctcacctgcccagctcccttattaggtcgagacattttaactaaattatctgcttccctgactattcctaggccacagccacacctcattgctgcccttttccccagttcaaagcctccttcacatcctccccttgtatctccccacctcaatccacaggtatgggacacctctactccctccttggcaactgatcatgcaccccttaccatcccattgaaacctaatcacccttaccccactcaatgccaatatcccatcccacagcacgtgttaaaaggattaaagcctgttatcactcacctgttacagcacggccttttaaagcctgtaaactctccttacaatttccccattttacctgtcctaaaactggacaagccttacagtttagttcaggatctgagtcttatcaaccaaaaccaaattgttttgcctatccaccccgtggtgccaaacccatatactctcctatcctcaatacctccctctacaacccattattctgttctagataaacctagctgaccccatagatcctatatcctttccctactttcctttccattccttaaaaaacagctcccacactagctctccctaactcatcactcccttttcattacacacaaccgaagtgcagggctgtgtggttgaaattcttacacaagagccagaccgtgccctgtagcctttctgtccagacaacttgaccttactgttttaggctggccatcgtgtctgcatgcagcggctgccactgctttaatacttttagaggccctaaaaatcacaaactatgctcaattcactctctacagttctcataacttccaaaatcgattttcttcctcacacctgatgcatatactttctgcccccaccccactacctctcagcaagccaaactcattaccttaactcgagccctcactcttgcaaaaggactacgcgtcaatatttatactgactctaaatatgccttccatatactgcaccaccatgctgttatatgggttgaaagaaatttcctcactacacaagggtcctccatcattaatgcctctttaataaaaactcttctcaaagctgctctacttccaaaggaagctggagtcattcactgcaagggccatcaaaaggcatcagatcccctcactgaggacaattcttatgctgataaggtagctaaaaaaacagctagtgttccaacttctatccctcagggcagtttttctccttctcatctggccactcccacctactcccccactaaaacttccacctgtcaatctcttcccacacaaggcaaatggttctcagaccaagggaaatatctccttccagcctcacaggcccattctattctgtcatcatttcataacctcttccatgtaggttacaagccactagcccaccccttagaacctctcatttcctttccattgtggaaatctatcttcaaggaaatcacttctcagtgttccagctgctattctactactcctcagggattgttcaggccccctcccttccctacacatgaagctcgggcccccgtccagaactggcaaattgactttactcatatgccccgagtcaggaaactaaaatacctcttggtctgggtagacactttcactggatgggtggaggcctttcccacagggtatgagaaagccactgtggtcatttcttcccttctgtcagacataattcctcgtttggcttttccacctctatacagtccgataacggacaggcctttattagtcaaatcacccaagcagtttctcaggctcttggtgttcagtgaactaacggtctttttaaaacacacttcaccaagctcagccaccaacttaaaaaggactggatacttttaccactttcccttctcagaattcgggcttgtcctcaaaatgttacagggtacagcccatttgagctcctgtatagatgctccttttattaggccccagtctcattccagacatcagaccaacttggactgcaccccaaaaacttgtcatccctactgtcttctgtctagtcatactcctattcaccattatcaactactcataaatgccctgctcttctttacactgccggtttacactgtttctccaagccatcacagctgatatctcctggtgctatccccaaaccgccactcttaactcttaaagtaaataaataatctttgctggcagggctatgctgaacccccttgagcactctctaattggatgtcctaggtcctcccaattcttagtcatttaatacctgtttttctccttctcttatttggaccttgtgtcttctgtttagtttctcaattcataacaaaactgtatccaggccatcaccaatcattctatatgacaactgtttcttctcacaaccccacaatatcaccccttaccacaaaatcttccttcagcttaatctctcccactctaggttcccatgccacccctaatcccgctagaagcaaccctgagaaacatcatccattatctttccataccaccccccgaaaaatttttaccatcccaacactttaccactattttgttttatttttcttattaatataagaagacaggaatatcaggtctctgagcccaagctaagccatcatatcccctgtgacctgcatgtatgcatccagatggcctgaagtaactgaagaatcacaaaagaagtgaaaatggcgcgtgcctgccttaactgatgacattaccttgtgaaattccttctcctggctcatcctggctcaaaagctcccccactgagcaccttgtgacccccactcctgcctaacagagaacaatcccctttgactgtaatttcccactacctacccaaatcctataaaacggccccacccctatctccattcactgactctttttggactcagcccacctgcacccaggtgaaataaacagccttgttgctcacacagaacctgtttggtggtctcttcacacggcgagtgaaa

SEQ ID NO: 259 - DNA, 447 bp, Homo sapiens
gtcaggcctctgagcccaaactaagccatcgcatcccctgtgacctgcacgtatatgcccagatggcctgaagtaactgaagaatcacaaaagaagtgaaaatggcctgttcctgccttagctgatgacattccaccacaaaagaagtgaaaatgggcagtccttgccttaagtgatgacattacctttccttttcctggctcatcctggctcaaaaaagctcccccactgagcaccttgtgaccccccactcctgcccaccagagaacaacccccctttgactgtaatattcctttacctaccccaatcttataaaacggccccacccctatctcccttcgctgactctctcttcggactcagcctgcctgcacccaggtgattaaaaagctttattgctcacacaaagcctgtttggtggtctcttcacacggacacgagtgaaa

SEQ ID NO: 260 - DNA, 6374 bp, Homo sapiens
gtcaggcctctgagcccaagctaagccatcatatcccctgtgacctgcacgtagtacacatccagatggccagttcctgccttaactgatgacattccaccacagaagaagtgaaaatggcctgttcgtgccttaactgatgacattatcttgtgaaattccttctcctggctcatcctggctcaaaagctcccctactgagcaccttgtgacccccacacctgcccgccagagaacaacccccctttgactataactttcctttacctacccaaatcttataaaatggccccacccatgtctcccttcgctgactctcttttcggactcagcccgcctgcacccaggtgataaaaagctttattgctcacacaaagcctgtttggtggtctcttcacacggacgcgcatgaaatttggtgccgtgactcagatcgggggacctcccttgggagatcaatcccctgtcctcctgctctttgctccgtgaaaaagatccacctacgacctcaggtcctcagacccaccagcccaaggaacatctcaccaattttaaatcgggtaagcgtcctcttcttactctgttctccaacctctctcactatccctcaaccactttctcctttcaatcttggcgccacccttcaatctctcccttctcttaatttcaatttctttcattttctggtagaggcaaaggacacacgttttatccgtggacccaaaactccggcgctggtcacggactcgggaaggcagccttcccttggtgtttaatcattgcagggatgcctgattattaacccatgtttaagagatgtctaaccacgcagggatgcctgccttggtccttcacccttagcggcaagtcccgcttttctgggggaggggaaagaaccctgaccccttctctccctgtctctaccccttctctgcttttcttgggggcaagaacccccccgatcccttatttctgcaccctgaccccttatctctgcaccccgatcccttatttccatgtcccaacctcttatctctgtgccctgatcccttatttccatgccccaacctcttatctctgtgccctgatcccttatttccatgccccaacctcttatctctgtgccccaaccccttatttctgtgccctgacctcttatctctgtgccctgatcccttatttccatgccccaacctcttatctctgtgccccaaccccttatttctgtgccccgacccctttcccacttttctggagggtaagaacccccaaaccccttccctccatatctctactctctcttttctctgggcttgcctccttcactataggcaaccttccaccctccattcctccttcttctcccttattctgtgttctcaagaacttagaacctcttcaactcacacctgacctaaaacctaaatgccttatcttcttctgcaacaccgcttggccccaatacaaacttgacaatggctctaaatggccagaaaacggcatttcgatttctccatcctacaagacctaaataatttttgttgaaaaatgggcaaatggtctgaggtgccttacgtccaggcgtttttcacacttcattccctccctagtctctgttcccgattcctcccaaatcctccttctttccctcctgcctgtcccctcagtcccaaccccaagcgtcgctgagtctttccagtcttccttttctacagacccatctgacctttcccctcctccccaggctgctcctcgccaggccgagctaggtcccaattcttcctcagcctcttctcctccaccctataatccttttgtcacctcccctcctcacacccagtccggtttacagtttcgttccgtaactagccctcccccacctgcccagcaatttcctcttaaaaaggtggctagagctaaaggatagtcaaggttaatgctcctttttctttatctgacctctcccaaatcagatagcgtttaggctctttttcatcaaatgtaaaaacacagcccagttcatggctcgtttggcagcaactctgagatgctttacagccctagaccctaaaaggtcaaaaggccgtcttattctcaatatacattttattacccaatccgctcctgacattaaataaaactccaaaaattaaattccggccctcaaaccccacaacaggacttaacctcaccttcaagatgtacaataatagagtagaggcagacaagtagtaacgtatttctgagttgcaattccttgcttccactgtgagacaaaccccagccacatctccagcacacaagaacttccaaacgcctaaaccgcagtggccaggcgttcctccaggcccgcctcccccaggagcttgctacaagtgccagaaatctggccaccaggccaaggaatgccagcagcccaggattcctcctaaaccacgtcccatgtgtgtgggaccccactgaaaatcagactgttcaactcacctggcagccactcccagagcccctgtaactctggcccaaggttctctgactgactccttcccagatcttctcggcttagcagctgaagactgacactgcctgatttcctcggaagccccctagaccatcacggacgcagagcttcaagtaactctcacagtggagggtaagtccgtccccttcttaatcaatacggaggctgcccactccacattaccttcttttcaagggcctgtttcccttgcctccataactgatgtgcgtattgacggccaggcttctaaacctcttaaaactccccaactctggtgccaacttagacaatactcttttaagcactcctttttagttatccccacctgcccagttcccttattaggccgagacactttaactaaattatctgcttccctgactattcctggactacagccacatctcattgccgcccttcttcccaatccaaagcctcctttgcgtcctcctcttgtatccccccaccttaacccacaagtataagatacctctactccctccttggcgaccgatcatgcaccccttaccatctcattaaaacctaatcacccttaccccactcaacgccaatatccaatcctgcagcacgctttaaaaagattaaagcctgttatcactcgcctgctacagcatggccttttaaagcctataaactctccttacaattcccccattttacctgtcctaaaaccagacaagccttacaagttagttcaggatctgtaccttatcaaccaaattgttttgcctatccaccccatggtgccaaacccatatactctcctatcctcaatacctccctccacaacccattattctgttctggatctcaaacatgctttctttactattcctttgcacccttcatcccagcctctcttcgctttcacttggactgaccctgacacccatcaggctcagcaaattacctgggctgtactgccacaagccttcacagatagcccccattacttcagtcaagcccaaatttcatcctcatctgttacctatctcggcataattctcataaaaacacacgtgctctccctgctgttcgtgtttgactaatctcccaaacctcaatcccttctacaaaacaacaactcctttccttcctaggcatggttagtgcgatcagaattcttacacaagagccgggaccgcaccctgtagcctttctgtccaaacaacttgaccttactgttttagcctagccctcatgtctgcgtgcagtgactgccattgctttaatacttttagaggccctaaaaatcacaaactatggtcaactcactctctacagttctcttaacttccaaaatctattttcttcctcacacctgatgcatatactttctgcttcccagctccttcagctatactcactctttgttgagtctcccacaattaccattgttcctggcccggacttcaatccggcctcccatattattctggataccacacctgaccctcatgactgtatctctctgatccacctgacattcaccgcatttccccatatttccttatttcctgttcctcaccctgatcacatttggtttattgatggcagttccaccaggcctaatcgctactcaccagcaaaggcaggctatgctatatatagtatcttccacatctatcactgaggctactgctctgtccccctccactacctctcagcaagccaaattagttgccttaacttaagccctcactcctgcaaaaggactacgcatcaatatttatactgattctaaatatgcctttcatattctgcaccaccatgctgttatatgggctgaaagaggtttcctcactacgcaaaggtcctccatcattaatgcctctttaataaaaacactgctcaaggccactttacttccaaaagaagctggagtcaattcactgcaaaggccatcaaaaggcatcagatcccattgctctaggcaacgcttatgctgataaggtggctagacaagcagctagctttccaacttctgtccctcatggccagtttttctccttcacatcagtcactcccacctattccccggctgaaacttccacctatcaatctcttcccacacaaggcaaatagttcttagaccaaggaaaatctccttccagcctcacaggcccattcaattctgtcgtcatttcataacctcttccatgtaggttacaagccactagcccatctcctagaacctctcatttcctttccattgtggaaatctgtcctcaaggaaatcacttctcagttttccatctgctattctactacccctcagggattgttcaggcctcctccctttcctacacatcaagctcagggatttgcccctgcccaggactggcaaattgagtttactcacatgccccgagtcagaaaactaaaatacctcttagtctaggtagacactttcactggatgggtacaggcctttcctacagggtctgagaaggccaccgcagtcattgcttcccttctgtcagacataattcctcggtttaggcttcccacttctatacagtctgataccagactggcctttattagtcacatcagccaagcatttttttcagactcttagtattcagtaaaacctttatatcccttacagtcctcagtcttcaggaaaggtagaacagactaatggtcttttaaaaacacacctcaccaagctcagccaccaacttaaaaaggactgggcaatacttttaccactttcccttctcagaagtcagacctgccctcggaatgctacagggtatagcccatttgagctcctgtaaggacgctcctttttattaggccccagtctcattccagacaccagaccaacttggactgtgccccaaaaaacttgttatccctactatcttctgtctagtcatactcctattcaccgttctcaactactcatacataccctgctcttgtttacactgccggcttacactgtttctccaagccatcacagctgatatctcctgttgctatccccaaactgccactctttactcttaaagtaaacaaataatcttcgctggcaggactatgctgaatctccttaggcagtctaattagatgtcctgggtcctcccaattcttagatctttaatacctgtttttctccttctcttatcccatttagtttttcaattcatacaaaactgtatccaggccatcaccaataattctaaatgacaaatgtttcttctaacaaccccccaatatcaccccttaccacaaaatcttccttcagcttaatctctcccactctaggttcccacgccacccctaatcccgcttgaagcagccctgagaaacatcgcccattatctctccataccatccccaaaaattttcgccatcccaacattttaccactatttcattttatttttcgtataatataagaagacaggaatgtcaggcctctgagcccaagctaagccatcatatcccctgtgacctgcacgtagtacacatccagatggccagttcctgccttaactgatgacattccaccacaaaagaagtgaaaatggcctgttcgtgccttaactgatgacattatcttgtgaaattccttctcctggctcatcctggctcaaaagctcccctactgagcaccttgtgacccccacacctgcccgccagagaacaactcccttttgactataattttccttcacctacccaaatcttataaaacggccccacccatatctcccttcgctgactctcttttcggactcagcccgcctgcacccaggtgattaaaagctttattgctcacacaaagcctgtttggtggtctcttcacacggacgtgcatgaa

SEQ ID NO: 261 - DNA, 3709 bp, Homo sapiens
gtcaggtctctgagcccaagataagccatcatatcccctgtgacctgcacatacacatccagatggctggttcctgccttaactgatgacattcctccacaaaagaagtgaaaatggtctgttcctgccttaactgatgacattcctccacaaaagaagtgaaaatggtctgttcctgccttaactgatgacattgtcttgtgaaattccttctcctggctcattctggctcaaaacctcccccactgagtaccttctgacccccactctgcctgccagagaacaaaccccctttgactgtaattttcctttgcctacccaaatcctataaaatggccccacccctatctccctttgctgactctctttcagacccagcccacctgcacccaggtgaaataaacagccatgttgctcacaaagtctgtttggtggtctcttcacatggacgcacatgaaatttggtgctgtgactcggatggggggcctcccttgggagatcaatcccatgtcctcctgttctttgctccatgaaaaagatccgcctacaacctcaggtcctcagacccagcagcccaaggaacatctcaccaattttaaatccggtaagcagcctcttcttactctcttctccaacctctccctgtccatcaaccactttctcctttccagtcttcaatctctccattctcttaatttcaattcctttcattttctggtagagacaaaggagacacgttttatccgtggacccaaaactctggcaccggtcatggactgcgaaggcagatttcccttggtgtttaatcattacagggatgcctctctgattattcaaccacgtttcaaaggtgtcagaccacccagggacgcctgccttggtccttcacccttagtggcaagtcccgcttttctgagggagggacaagtaccccaaccccttctctccatgtctctaccccttctctgcttttctgggggaggggcaaatacccctcaaccccttctccttcacccttagtggcaagtcctgcttttctgggggaggtgcaagcaccccaaccccttctctccatgtctctaccccttctccacctttcaggggggcaagaaacccccaaccccttctccttcacccttagtggcaagtcccacttttctgggggaggtacaagtaccccaacctcgtatctctgcaccccaatcccttatttctgcacactggccccttttctctgtgccccaatcccttatttccacaccctgacctcttatatctctgcaccccaatcccttatttccatgcctggacctcgtatctctgtgccccgacccctttcccacttttctgtagggtaagaacccctgaaccccttccctccgtgtctctactctctcttttctctgggcttgcttcctacactatgggcaaccttccaccctccattcctccttcttctcccttagcctgtatttttaagaacttaaaacctcttcaactctcacctgacctaaaatctaagcatcttattttcttctgcaatgctgcttgaccccaatacaaactcaacagtagttccaaatagccagaaaacggcactttcaatttttccatcctgtaagatctaaataattattgccgtaaaataagcaaactgtctgaggtgcctgacttccagacattcttttacacatcagtcccttcctagtctctgtgcccaaagcaactcgtcccaaatcttcctcctttccctcccgcctgtcccctcagtcccaaacccaagcattgctgagtctttctaatcttccttttctacagacccatctgacctctcccctcctccccaggctgctcctcgccaggccaagctaagtcccaattcttcttccgcctccactcctccactctataatccttttttcacctcccctcctcaccccgggtccggcttacagtttcatttcatgactagccctccccaagctgcccagcaatttgctcttaaacaggtgcctggagctaaagacatagtcaaggataatgctcctttttctttatcccaaatcagatagcatttagcctctttttcatcaaatataaaaatccagcccagttcatggcttgttcagcagcaaccctgagacgctttgcagccctagaccctaaaaagtcaaaaggctgtcttattctaaatatacattttatttcccaatctactcccgacattaaataaaactccaaaaattaaattctggtcctcaaaccccacaacaggatttaattaacctcaccttcaagatgtacaataatagaaaaaagttgtaattccttacctccactctgagacaaatcccagccacatctccagcacacgagaacttccaaacgcctgaaccgcagtggccaggtgttcctccagaacatcttcccccaggagcttgctacaagtgtcagaaatctggccaccaggccaaggaatgcctgcagcccaggattcctcctaagccacgtcccatctgtgcggaaccccactggaaatcggactgttcaactcacctggcagctgctcccagagcccctggaactctggcccaagcttctctgactgaccccttctcagcttagtggctgaagactgacgctgcctaattgcctcggaagccccatagaccatcatggatgccgagctttaggtaactctcacagtggaagataagtccgtccccttcttaagcaatatggaggctacccactccacactactttcttttcaagggcctgtttcccttgcctccataactgttgtgggtattgacggccaggcttctaaacctcttaaaactccccaactctagtgccaacttagacaatactcttttaaacactcctttttagttatccccacatgcccagttcccttatttggccaagacactttaactaaattatctgcttccctgactattcctgggtacagccacacctcattgccacgttttcccccagttcaaagcctccttcacatcctcctcttgtattaccccaccttaacccacaagtataggatacctctactccctccttggcgaccgatcatgcacctcttaccatcccactaaaacctaatcacccttaccccactcaatgccaatatcccatcccgcagcatgctttaaaaaggttaaagcctgttatcactcgcctgctacagcatggccttttaaagcctataaactctccctacaattcccccattttacctgttctaaaaccagacaagccttacaagttagttcaggatctgcgccctatcaaccaaattgttttgcctatccaccccatggtgccaaacccatatactctcctatcctcaatacctccctctactacccattattctgttctggatctcaaacatgctttctttactattcctttgcacccgtcatcccagcctctcttcgctttcacttggactgaccctgacacccatcaggctcagcaaattacctgggctgtactgccacaagccttcacagacagcccccattacttcagtcaagcccaaatttcatcctcatctgttacctatctcagcataattctcataaaaacacacgtgctctccctgctgatcgtgtctgattaatctcccaaacctcaatcccttacaaaagaacaactcctttccttcctaggcatgcttag

SEQ ID NO: 262 - DNA, 158 bp, Homo sapiens
caggagagttggatgaccatcaggtgacggtcaggcggttgttaactgtctctctaaagtaataattggtcacagctggcaccaggcaaaggcacgcttctaatagatagaaaatacctgaaactgatgatcagcagcttcctgataagatctcagga

SEQ ID NO: 263 - DNA, 5854 bp, Homo sapiens
atcaggcctctgagcccaagctaagccatcatatcccctgtgacctgcacatacacatccagatggccggttcctgccttaactgatgacattccaccgcaaaagaaatgaaaatggcctgttcctgccttaactgatgacattatcttgcgaaattccttctcctgcctcaccctggctcaaaagctcccctactgagcaccttgtgacccccactcctgcccaccaaagaaaaatccccctttgactgtaattttcctttacctacccaaatcttataaaacggccccacccctatctccctttgctgactcttttcagactcagcccccctgcacccaggtgaaataaacagctttattgctcacacaaatcctgtttggtggtctcttcacacagacgcgcataaaatttggtgccgtgactcagatcgggggacctcccttgggagatcaatcccctgtcctcctgctctttgctccatgaaaaagatccacctacgacctcaggtcctcagacccaccagcccaaggaacatctcaccaattttaaatcaggtaagtggcctcctcttactctcttctccaacctctctcactatccctcaaccactttctccttcaatcttggcgtcacccttcaatctctcccttctcttaatttcaattcctttcattttctggtagagacaaaggagacacgttttatctgtggattatccatggacccaaaactccggtgtccatcaaggacttgggaaggcagacttcccttggtgtttaatcattgcagggatgcttttctgattattcacccacgtttcagaggtgtctgaccacgcagggatgtctgccttggtccttcacccttagcgccaagtcccgcttttctggcagagggccaagaactccaaccccttcactccgtgtctctaccccttctctgcttttctgggtggcaagaacccctgatcccttatttccatgccccaacccctgatctctgcaccctgatcccttattttcatgccctgacctcttatttctgcaccccaaccccttatttccataccccgacccctttcccacttttctggagggtaagaacccctgaacccttcccttcatgtctctactctcccttttctttaaacttgcctccttcattatgggcaaccttccaccctccattcctccttcttctcccttagcctgtgttcataagaacttaaaacctcttcaactctcgcctgacctaaaatctaagcatcttattttcttctgcaacaccgcttagccccaatacaaatttgacaatggctctaaatagccagaaaatggcactttcatgttttccatcctacaagatctaaataattcttgttgtaaaatgggcaaatggtctgaggagcctgacatccaggcattcttttacatatcagtccctccctagtctctgttcccaatgcaactcatcccaaatcttccttctttccttcctgcctgtcccctcagtcccaaccccaagcatcgctgagtctttctaatcttccttttctacagacccatctgacctctctcctcctagccaggccaggctaggtcccaattcttcctcagcctccactcctccaccctataatccttttatcacctcccctcctcacacctggtctggcttacagtttctttccccgactagccctcccccacctgcccagcaatttcctcttaaaaaggtggctggagctaaaggcatagtcaaggttaatgctcctttttctttatctgacctctcccaaatcagttagtgtttaggctctttttcatcaaatataaaaaacccagcccatttcatggccccttagcagcaaccctgagatgctttacagccctagaccctgaaaggtcaaaaggccgtcttactctcaatatacattttattttattacccaatctgctcccgacattaaataaagctccaaacattaaattccggccctcaaaccccaaaacaggacttaattaaccttgccttcaaggtgtacaataatagagtagaggaagccaagtagcaacatatttctgagttgcaattctttgcctccactgtgagacaaaccccagccagccacatctccagcacacaagaactcccaaatgcctaaactgcagtggccaggcgttcctccaggcccgcctcccccaggagcttgctacaagtgccagaaatctggccaccagaccaaggaatgcccgcagcccaggattcctcctaagctgcttcccatctgtgcaggaccccactgaaaatcggactgttcaacttacctggcaaccactcccagagcccctggaactctggcccaaggctctctgactccttcccagatcttctcggcttagcagctgaagactgacactgcccgatagcctcggaagcctacaggaccatcacagatgctctaggtaactctcacagtgcagggtaagtccatccccttcttagtcaacatggaggctacccactccacattaccttcttttcaaaggcctgcttcccttgcctccataactgttgtgggtattgacagccaggcttctaaacctcttaaaactccccaactctggtgccaacttagacaatactcttttaagcactccttttaattatccccacctgcccagttcccttattaggctgagacactttaactaaattatctgcttccctgactattcctggactacagctgcatctcattgctgcccttcttcccaatccaaagcctcctttgcatcctcctcttgtatccccccaccttaacccacaagtataagacacctctactccttccttggcgacaaatcacgcaccccttaccatctcattaaaacctaatcacccttaacccactcaatgccaatatcccaccccacagcatgctttgaaaagattaaagcctgttatcactcgtctgctacagcatggccttttaaagcctataaactctccttacaattcccccattttaactgtctagaaccagacaagccttacaggtttgttcaagatctgcaccttatcaacaaaattgttttgcctatccaccccatgatgccaaacccatatactctcctatcctcaatacctccctccacaacccattattctgttctagatctcaaacatgctttctttactattcctttgcacccttcaccccagcctctcttggctttcacttagactgaccctgacacccatcaggctcagcaaattacctgggctgtactgccgcaaggcttcacagacagcccccattacttcagtcaagcccagatttcttcctcatctgttacctatctcggcataattctcataaaaacacacgtgctctccctgtggatcatgtccagctgatctctcaaacccccaacacctacaaaacaacaactcctttccttcctaggcatggttagatactttcgactttagatacctggttttgccatcctaacaaaaccattatataaactcacaaaaagaaacctagctgaccccatagatcctaaatcttttccccactcctctttccgttccttgaagacagctttagagactgccccgaccctagctctccctgactcatctcaacccttttcattacacacagctgaagtgcagggctgtgcagtcagaattcttacaaaaggaccaggatcgcgtcctgtagcctttttgtccaaacaacttgaccttactgttttaggctggccatcatgtctccatgcagtggctgctgccaccctaattctttagaggcccttaaaatcacaaactatgctcaattcactctctacagttctcataacttccaaaatctattttcttcctcacacctgacacatatactttctgcttcccggctccttcagctgtactcactctttgttaagtctcccacaattaccattgttcctggcccagacttcaatctggcctcccacgttattcctgataccacacctgacccctatgactgtatctctctgatccacctgacattcaccccatttccccatattttcttctttcctgttcctcaccctgatcacacttagtttattgatggcagttccaccaggcctaatcaccacacaccagcaaaggcaggccatgctatagtacaagccactagtccacctcttaaaacctctcatttcctttccatcgtggaaatctatcctcgaggaaataacttctcagtgttccatctgctattctactacttctcagggattattcaggcctcctcccttccctatacatcaagctcaaagacttgcccccacccaggactggcaaattagctttactcaacatgccctgagtcagataactaaaattcctcttagtctaggtagacactttcactggataggtagaggcctttcctacaaggtctgagaatgccaccgcagtcatttcttcccttctgtcagatataattcctcagttgagccttcccacctctatacagtctgataacagatcagcctttattagtcaaatcagccaaacagttttttaggctcttagtattcagtgaaatctttatatcccttacattcctcagtcttcaggaaaagtagaacggactaaagatcttttaaaaacacacctcaccaagttcagctgccaacttaaaaaggactagacaatacttttactgctttcccttctcagaattcaggcctgtccttggaatgctatagggtacagaccatttgagctcctgtatggatgctcctttttattaggccccagtctcattccagacaccagaccaacttggactgtgccccaaaaaacttgtcatccctactatcttctgtctagtcatactcctattcaccgttctcaactactcaaacatgccctgttcttgtttacactgccagtttacactgtttctccaagccatcacagctgatatctcctggtgctgtccccaaactgccactcttaactcttaaagtaaataaataatctttgctggcaggactatgctgaacctccttaggcactccctaattaaatatcctaggtcctcccaattctcagacctttaatacctgtttttctccttctcttattccatttttcaattcatacaaaaccgtatccaggccatcaccaatcattctgaatgacaaatgtttcttctaacagtcccacaatatcaccccttaccacaaaatcttccttcagcttaatctctcccactctaggctcccacgctgcccctaatcctgctcgaaacagccctgagaaatatcgcccattatctctccaaaccatccccccaaatttttgccgtcccaacactttaccactatttcattttatttttcttattaatataagaagacaggaatgtcaggactctgagcccaagctaagccatcatatcccctgtgacctgcacatacacatcctgatggccggttcctgccttaactgatgacattccaccacaaaagtaatgaaaatggcctgttcctgccttaaccgatgacattatcttgtgaaattccttctcctggctcatcctggctcaaaagctcccctactgagcacgttgtgacccccactcctgcccgccaaagaaaaacccccctttgactgtaattttcctttacctacccaaatcttataaaacagccccacccctatctcccttcactgactctctttttggactcagcctgcctgcacccaggtgaaataaacagctttattgctcacacaaatcctgtttggtggtctcttcacacggacgcgcataaaa

SEQ ID NO: 264 - DNA, 3477 bp, Homo sapiens
tgactgactctttctcagatcttctcggtttagtggctgaagactgatgctgcctgatcgcctcggaagccctgtagaccaacacggacgccgagctttagataactctcacagtggagggtaagtccgtcctcttcttaatcaatatggaggctacccagtccacattaccttcttttcaagggcctgtttcccttgcctccataactgctgtgggtattgacagccaggcttctaaacctcttaaaactccccaactctgtgccaacttagacaatactcttttaagcactcctttttagttatccccacctgcccagttcccttattaggccgagacacgttaactaaattatctgcttccctgactattcctggactacagctgcatctcattgccacccttcttcccaatccaaagcctcctttgtgtcctcctcttgtatccccccaccttaacccacaagtataagacacctctactccctccttggtgaccgatcatgcaccccttaccatctcattaaaacctaatcacccttaccccgctcaatgccaaaatcccatcccacagcatgctttgaaaggattaaagcctcttatcactggcctgctacagcatggccttttaaagcctataatctctccttacaattcccccatttcacctgtgctaaaaccagacaagccttataagttagttcaggatctatgccttatcaaccaaattgttttgcctatccaccccatggtgccaaacccatatactctcctatcctcaatacctccctccacaatccattattctgttcttgatctcaaacatgctttctttgctattcctttgcacccttcatcccagcctctcttcactttcacttggactgaccctgacaaccatcaggctcagcaaattacctgggttgtactgctgcaaagcttaacagacagaccccattacttcagtcaagcccaaatttcttcgttatctgttacctatctcagcataattctcataaaaacacacgtgctctccctgctgatcatgtctgactaatctctcaaaccccaaccccttctacaaaacaacaacttctttccttcctgggcatggttggatacttttgcctttggatacctggttttgccatcctaacaaaaccattatataaactcacaaaaggaaacctagctgaccccatagatcctaaatccttccccactcctctttctgttccttgaagacagctttagagactgcccccaccccagctctccctgactcatcccaacccttttcattacacacaaccaaagtgcagggctgtgcagtcagaatacttacacaaggactgggatcacgtcctgtagcctttttgtccaaacaacttgaccttactgttttaggctggccatcatgtctccatgcagtggctactgccatcctaatacttttagaggcccttaaaatcacaaactatgctcaactcactctctacagctctcataatttctaaaatctgttttcttcctcacacctgatgcatatactttctgctccctggctccttcagctgtactcactctttgttgagtgtcccacaattaccattgttcctggcccggacttcaatccagcctcccacattattcctgataccacacctgaccctcatgactgcatctctctgatccacctgacgttcaccccatttccctacatttcctccttccctgtttctcaacctgatcacacttggtttattgatgacagttccaccaggcctaatcaccacacaccagcaaaggcaggctatgctatagtacaagccactagcctgcctcttagaacctctcatttcctttccatcatggaaatctatcctcaaggaaataacttctcagtgttccttctgctattctgctactcctcagggattattcaggccccctgccttccctacacatcaagctcagggatttgcccccgcccaggactggcaaattaactttactcaaaatgccccgagtcaggaaactaaaatacctcttggtctaggcagacactttcactggataggtagaggcctttcccacagggtctaagaaggccaccaaggtcatttcttcccttctgtcagacataattcatcggtttggccttcccacctctatacagtccgatagcagactggcctttattagtcaaatcagccaagcattttttcaggctcttagtattcagtgaaaactttatatcccttacagtcctcagtcttcaggaaaggtagaacagactaatggtcttttaaaaacacacctcaccaagctcagccaccaacttaaaaaggactggacaatacttttaccactttcctttctcagaattcaggcctgtcctcagaatgctacaaggtacagcccatttgagctcctgtatagacgctctttttattaggccccagtctcattccagacaccagaccaacttggactgtgccccaaaaaacttgtcatccctactatcttctgtctagtcatactcctattcaccattctcaactactcatacatgccctgctcttgtttacactgccagtttacactgtttctccaagccatcatagctgatatttcttggtgctatccccaaaccaccactcttaactcttaaagtaaataaataatctttgctggcaaagctatgttgaacctccttaggcactttctaattagatgtcctaggtcctcccaattcttagtcctttaatacctgtttttctcctgctcttattctgtttagtttttcaattcatacaaaactgtatccaggccatcaccaataattctaagtgacaaatgtttcttctaacaaccccacaatatcacttcttaccacaaatcttccttcagcttaatctctcccactctaagttcccacgccacccctaatcccgctagaagcagccctgagaaacattgcccattatctctccataccacccccaaaaaattttcaccatcccaacactttaccactattttgttttatttttcttattaatataagaagacaggaatatcaggcctctgagcccaagctaagccattatatcccctgtgacctgcacgtacacatccagatggccggttcctgccttaactgatgagattccaccacaaaagaagtgaaaatggcctgttcctgccttaactgatgacattgtcttgtgaaattcattctcctggctcatcctggctgaaaagctcccctactgagcaccttgtgacccccactcctgcccaccagagaacaacccccctttttcctttacctacccaaatcctataaaacggccccacccctatctcccttcactgactctctttttggactcagcctgcgtgcacccaggtgaaataaacagctttattgctcacacaaaggctgtttcgtggtctcttcacatggacacg

SEQ ID NO: 265 - DNA, 952 bp, Homo sapiens
gtggggataagaaagagaaatcagactgttactgtgtctatgtagaaagaagtagacataagagactccattttgttctgtactaagagaaattcttctgccttgagatgctgtgaatctgtaaccctagccccaaccctgtgcccgcagaaacacgtgctgtgttgactcaaggtttaatggatttagggctgtgcaggatgtgctttgttaaaaagcgcttgcaggcagtatgcttggtaaaagtcatcgccattctccagtctcgagtacccagggacacaatacactgtggaaggccgcagggaactctgcctaggaaaaccaggtattgtccaaggtttctccccatgtgatagcctgagatatggcctcatgggaagggaaagacctgaccatcccccagcctggaacccataaagggtctgtgctgaggattagtgaaagaggaaggcctctttgcagttaagataagaggaaggcatctgtctcctgcttgtccttgggcaatagaatgtctaggtgtaaaacctgattgtatgttctatttactgagataggagaaaaccgccttagggctggaggtgagacatgctggcagcaatactgctctttactgcaccaagatgtttgtatacatgcacatcaaggcacagcacgtttccttatttatgacagagatcttggttcgtatgttttcctgctgaccctctccccactattacctttgtcctgccacatccccctctccgagatggtagagatagtgatcaataaatactgagggaactcagagaccgggccggcgcgggtcctccgtatgctgagcgccggtcccctgggcccacttttctttctctgtactttgctctgtgtctctttctttttctgagtgtttcattccacctgacgagaaacacccacaggtgtggaggggcaggccaccccttca

SEQ ID NO: 266 - DNA, 2538 bp, Homo sapiens
atcgttatcctcctatttgcctagggaaagcaccaggatgtttaatgcctacagtccaaaattggttggtggaagtacctactgtcagtcccatcagtagattcacttatcacatggtaagcgggatgtcactcaggccacgggtaaattatttacaagacttttcttatcaaagatcattaaaatttagacctatagggaaaccttgccccaaggaaattcccaaaggatcaaaaaatacagaagttttagtttggaaagaatgtgtggccaatagtgcggtgatattacaaaacaatgaattcggaactattatagattgggcacctcgagtcaattctaccacagttgctcaggacaaactcggtcgtgtccaagtgcacaagtgagtccagctgttgatagcgacttaacagaaactctagacaaacataagcataaaaaattacagtctttctacccttgggtatggggagaaaaaggaatctctaccccaagaccaaaaataataagtcctgtttctggtcctgaacatccagaattatggaggcttactgtggcctcacaccacattagaatttggtctggaaatcaaactttagaaacaagagattgtaagccattttatactatccacctaaattccagtccaacggttcctttacaaagttgcgtaaagcccccccttatatgctagttgtaggaaatatagttattaaaccagactctcaaactataacctgtgaaaactgcagattgtttacttgcattgatttgacttttaattggcaacaccgtattctgctggggagggcaagagagggcgtgtgggtccccgtgtccacggactgaccgcaggaggccttgccatccgtccgtattttgactgaagtattaaaaggcgttttaaatagatccaaaagattcatttttactttaattgcagtgattatgggattaattgcagtcacagctacggctgctgtagcaggagttgcattgcactcttctgttcagtcggtaaacttttaatgattggcaaaaaaattctacaagattatggaattcacaatctagtattgatcaaaaattggcaaatcaaataatgatcttagacaacctgtcatttggatgggagacaggctcatgagcttagaacattatttccagttacagtgtgactggaatacgtcagacttttgtattacaccccaaatttataatgagtctgagcatcactaggacatagttagacgccatctacagggaagagaagataatctcactttagacatttccaaattgaaagaacaaattttcgaagcatcaaaagcccatttaaatttggtgccaggaatggaggcaatcgcaggagtggctgatggcctcgcaaatcttaaccctgtcgcttgggttacgaccatcggaagttctatgattataaatctcatattaatccttgtgtgcctgttttgtctgttgttagtctgcaggtgtacccaacagctccgaagagacagcgaccatcgagaacgggccatgatgacgatggcggttttgtcgaaaagaaaagggggaaatgtggggaaaagcaagagagatcagattgttactgtgtctgtgtagaaagaagtagacatgggagactccattttgttctgtactaagaaaaattcttctgccttgagattcggtgaccccacccccaaccccgtgctctctgaaacatgtgctgtgtccactcagggttgaatggattaagggcggtgcgagacgtgctttgttaaacagatgcttgaaggcagcatgctcgttaagagtcatcaccactccctaacctcaagtacccagggacacaaacactgcggaaggccgcagggtcctctgcctaggaaagccaggtattgtccaaggtttctccccatgtgacagtctgaaatatggcctcgtgggaacggaaagacctgaccgtcccccagcccgacacccgtaaagggtctgtgctgaggaggattagtaaaaggaaggaatgcctcttgcagttgagacaagaggaaggcatctgtctcctgcccctccctgggcaatggaatgtctcggtataaaacccgattgtacgttccatctactgagatagggaaaaaccgccttagggctggaggtgggacctgcgggcagcaatactgctttgtaaagcattgagatgtttatgtggatgcatatctaaaagcacagcacttaatcctttaccttgtctatgatgcaaagacctttgttcacgtgtttgtctgctgaccctctccccactattgtcttgtgaccctgacacatccccctcttcaagaaacacgcacgaatgatcaataaatactaagggaactcagaggctggcgggatcctccatatgctgaacgctggttccccgggtccccttatttctttctctatactttgtctctgtgtctttttcttttccaagtctcttgttccacctaacgagaaacacccacaggtatggaggggcaacccaccccttca

SEQ ID NO: 267 - DNA, 1486 bp, Homo sapiens
ccacaaccaggaatgtcaggcagccaccaggtgatggtcagatggttgagtttttgttgttgctttttgtttttttgtttttgagacggaatttctctcttgttgcccaggctggagtacaatggcgcgatctcggctcacagcaacttccgcctcccgggttcaagctgttctcctgcctcagcctcccaattagctgggattacaggcatgtgccatcacgcctggctcattttgtatttttagtggagacagggtttctccatgttggtcaggctggtctcaaattcccgacctcaggtgatccgcctgcctcagcctcccaaagtgctgggattacaggcatgagccaccacgccgggcctgttttttgtttttgagacggaggcttgctctgttgcccaggctggagcacaatggtgtgatcttggctactgcattctccgcctcccaggttcaagcgattctcctgcctcagcctcccgagtagctgggattacaggcgcccaccaccataccctgctaacttttgtatttttagtagagacggggtttcaccatgttggccaggctggtctcgaactcctgacctcaggtgatttcccacctcggcctcccaaagtgctaggattacaggtgtgagccaccgcacccggcctgttgttgtttgttgacacagagtcttgctctgttgcccaggctggagtgcagtggagccatctcagctcactgcagcctccatctccccagctcaagtgatcctcccacctcagcctcctgagtagctgggactacagcctccaccaccacacccagcttgcttatttatttatttatttatttatttagtatttttagtagagctggggtttcaccatgttagccaggctggtctcaaactcctgacttcaggtaatccacccacctcagcctcctaaagtgctgggattacaggcatgagccacctcacccagcagtcaggtggttggtaactgtctctctaaaataataattggttgcaaccaacaccagggaaaggcagtttcccaatagatagaaagcacctggaactggtgatcagcagcttcccgataagatctcaggagctgggcgagtgggctcaagcatgtgcactaagaggcaacatggtggagtttaactggcatatgacctgggagcatttgactggtaaaggaagaatgcctcaagtaagcatgcgcacttcagtaaacacgctgcgcatgaggcccctcccgagcgctggcaggccactgcgcatgcggcccctcccgagtgctggcaggccactgcgcatgcggacagaccaccccaagggaagaatcggggaaagttaacgcaagccccggaaggatgccaacgtatcaaacgccaagtccaaggtcaaacagtgcacttgactctcaagtcacctgcttgaccctcttccaagtgtactttacctcctttccttactgccctaaaacct

SEQ ID NO: 268 - DNA, 436 bp, Homo sapiens
ttacagtaggtaactagtcagatgtgagcagggcaggagagagccccgccaaataccaggaatgtcaggtggccatcaggtgatggtcaagtggttgttaactgcctctttaaaataataattggttgcagctggtgccagggaacagcagtctcccaacagatagtaaagacttgaaattggtgatcagcagcttcccgataagaactcaggagttgggcaagtgggctcgcacatgtgcattaagaggcaaaatggcagagtataactagtatatcatcttctaggaacattctactggtaaggaagaaagcctcaagtgagcatgtgcacaacttctgtaaaaacactgcatatgtggctcctcccaagtgctggcaggtcactgtgcatgtgaacagcccgccccaagggaagaaacacgggagaagggatg

SEQ ID NO: 269 - DNA, 604 bp, Homo sapiens
tcagagtaggtagttaggcagatatggacagggcaggagagcacccaaacacgcacacccccaccccctgttgcccccaggactgtcaggcgaccatgaggtgatagtcaggtggttgttaaactgtctctctaaaatgataagtggtcacagccagcgccaggaaaagatagtctcctaacagatagaaaacactcggtgctggtgttatccacttctcaggaagatctcaaacaggcccactaagaggcaaaatggcctcttatacgaccttccaatgggaacgctcgacaggtaagggaaaaactcctcaagtgaacacgtgcacaacttcagcaaacccaagaaccatagcaatgtataaaatcccaagtcaagggatgaacagggcacttggatcttgcaagtcacctgcttggcccttccaagtgtactgcttcctttcactcctgctttaaaactttttaacaaattctcactcctgttctaaaacttgcctcagtctctccctctgccttaaaccaactactgcccttcagcaaaattctttcctccaaggaggcaagaatcaagttgttgcagacccataaagattcaccactgc

SEQ ID NO: 270 - DNA, 5672 bp, Homo sapiens
gtcaggcctctgagcccaagccaagccatcgcatcccctgtgacttgcacgtatacgcccagatggcctgatgtaactgaagaatcacaaaagaagtgaaaaggccctgccccgcctcaactgatgacattccaccatggtgatttgttcctgccccaccttaactgagtgattaaccctgcgaatttccttctcctggctcagaagctccccaactgagcaccttgtgacccccgcccctgcccaccagagaacaaccccctttgactgtaattttccattaccttcccaaatcctataaaatggccccacccctatctccctttgctgactctctttttggactcagcccgcctgcacccaggtgaaataaacagccatgttgctcacacaaagcctgtttggtggtctcttcacacggacgtgtatgaaatttggtgccgtgactcggatcaggggacctcccttgggagatcaatcccccatcctcctgctctttgctccgtgagaaagatccacctacgacctcaggtcctgagactgaccagcccaagaaacatctcaccaatttcaaatccggtaagcggcctctttttactctcttctccaacctccctcactatccctcaacctctttctcctttcaatcttggcgccacacttcaatctctcccttaatttcaattcctttcattttctggtagagacaaaggagacacgttttgtccgtggacccaaaactccggtgccagttacggactgggaaggcagccttcccttggtgtttaatcattgcagggatgcctctctgataattcacccacatttcaaaggtgtcagaccacgcagggacgcctgccttggtccttcacccttagcggcaagtcccacttttctgggggagtggcaagtacccctcaaccccttctccttcacccttagtggcaagtcctgcttttctagggggcaagaacccccaatcccttatttccacacccgaacctcatatctctgtgccccaatcccttatttccatgccccgaccccttacttctgtgccccatcccttatttctgccccccgacctcttatctctgcaccccaaccccttttcccacttttctggaaggtaagaacccccgaaccccttccctccgtttctatactctctcttttctctaggcttgcttccttcactataggcaaccttccaccctccattcctccttctactcccttggcctgtgttctcaaaaacttaaaacctcttcaactcacacctgacctaaaacctaaatgccttattttcttctgcaatgctgcttgaccccaatacaaactcgacagtagttccaaatagccagaaaatggcactttgaatttttccatcctgcaagatctaaataattcttgtcgtaaaataggcaaacggtctgaggtgcctgacgtccaggcattcttttacacatgagtcccttcctagtctctgtgtccagtgcaactcatcccaaatcttccttctttccctcccacctgtcccctcagtaccaaccccaagcgtcactgagtctttctaatcttccttttctacagacccgtctgacctctcccctcttggccaggccgagctaggtcccaattcttcctcagcctctcctcctccaccctataatctttttatcacctcccctcctcacaaccctggtccagcttacagtttcattccgtgactagccctcccccacctgcccagcaatttactcttaaaaaggtggctggagccaaaggcatagtcaaggttaatgctcctttttctttatcccaaatcagatagcgtttaggctctttttcatcaaatataaaaatccagcccagttcatgacttgtttggcagcaaccctgagacactttacagccctagaccctaaaaagtcaaaaggctgtcttattctcaaaatacattttattacccaatctgctcctgacattaaataaaactccaaaaattaaattccggccctcaaaccccacaacaggatttaattaacctcgccttcaaggtgtacaataatagaaaaaagttgcaattccttgcctccactgtgagacaaaccccagccacatctctagcacacaagaacttccaaacacctgaaccgcagtggccaggcgttcctccagaacctcctcccacaggagcttgctacacatgccagaaatctggccattgggccaaggaatgccagcagcccaggattcctcctaagccgcgtcccatctgtgtcggaccccactgaaaatcggactgttcaactcacctggcagccactcccagagcccctggaactctggcccaaggctctctgactgactccttcccagatcttctcagcttagcggctgaagactgacactgcccgatcgcctcggaagcccactagaccatcacggacgccgagcttcgggtaactctcacagtggaaggtaagcccgtccccttcttaatcaatacggaggctacacactccacattaccttcttttcaaggacctgtttcccttgcctccataactgttgtgggtattgacggcaaggcttctaaacctcttaaaactccccaactctggtgccaacttagacaatactcttttaagcactcctttttagttatccccacctgcccagttcccttattaggctgagacactttaactaaattatctgcttccctgactattcctggactacagctatatctcattgctgcccttcttcccaatccaaagcctcctttgcatcctcctcttgtaacaccccaccttaacccacaagtataggatacctctactccctccttggcaaccgatcatgcaccccttaccatctcattaaaacctaatcacccttaccccccaatgccaatatcccatcccgtagcacgctttaaaaagattaaagcctgttatcactcgcctgctacagcatggccttttaaagcctataaactctccttacaattcccccattttacctgtcctaaaaccagacaagccttacaagttagttcaggatctgcgccttatcgaccaaattgttttgcctatccaccccgtggtgccaaacccatatactctcctatcctcaatacctgcctctataacccattattctgttctagatctcaaacatgctttctttactattcctttgcacccttaatcccagcctctcttcactttcacttggactgaccctgacacccatcaagctcagcaaattacctaggctgtactgccacaaagcttcacagacagcccccattacttcaatcaagcccaaatttcttcctcatctgttacctatctcggcataattctcataaaaacacacgtgctctccctgccaatcgtgtctgactgatctctcaaaccccagtaccttctataaaacaacaactcctttccttcctaggcatggttagcgtggtcagaattcttacacaagagccaggaccacaccctgtagcctttctgtccaaacaacttgaccttactgttttagcctagccctcatgtctgcgtgcagtggctgccactgcattaatacttttagaggccctcaaaatcacaaactatgctcaactcactctctacagttctcataacttccaaaatctattttctcctcatacctgatgcatgtactttctgcttcccggctccttcagctatactcactctttgttgagtctcccacaattaccgttgttcctggcccagacttcaatccggcctcccacattattcctgataccacacctgacccccatgactgtatctctgatccacctgacattcaccccatttccccaaatttccttctttcctgttcctcaccctgatcacccttgatttattgatggcggttccaccaggcctaatcgccacacaccagcaaaggcaggttatgctataatacaagccactagcccgcctcttagaacctctcatttcctttccatcctggaaatctatcctcaaggaagtaacttctcagtgttccatctgctattctactactcctcagggattattcaggccccctcccttccctacacatcaagctcgaggatttgcccccacccaggactggcaaattagctttactcaacatgccctgagtctgataactaaaatacctcttagtctaggtagatactttcactggataggtagaggcctttcctacagggtctgagaaggccaccgcagtcatttattcccttctgtcagacataattcctcagtttagccttcccacctcaatacagtctgataacagaccagcctttattagtcaaatcagccaagcagtttttcaggctcttagtattcagtgaaacctttacatcccttacggtcctccgtcttcaagaaaagtagaacggactaaaggtcttttaaaaacacacctcaccatgctcagccaccaacttaaaaaggactggacaatacttttaccactttcccttctcagaatttagggctgtcctcggaatgctacagggtatagcccatttgagctcctgtatagacgctcctttttattaggccccagtctcattccagacaccagaccaacttagactgtgcccccaaaaaaacttgtcatccctactatcttctgtctagtcatactcctattcaccattctcaactactcatacatgccctgctcttgtttacactgccagtttacactgtttttccaagccatcacagctgatatctcctggtgctatccccaaactgccactcttaactcttgaagtaaataaataatctttgctggcagaactatgctgaatctccttaggcactctctaatcagatatcctgagtcgtcccaattcttagaccttttataccggtttttcttcttctgtttttccatttagtttctcaattcatccaaaaccgtatccaggccatcaccaatcattgtatacgacaaatgtttcttctaacatccccacaatatcaccccttgccacaagacctcccttcagcttaatctctcccactctaggttcccatgctgcccctaatcccgcttgaagcagcgctgagaaacatttcccattctcttctctccatatcacccaccaaaaattttcgccgccgcaacacgtcaacaccattttgttttatttttcttattaatataagaaggcaggaatgtcaggcctctgagcccaagccaagccatcgcatcccctgtgacttgcacgtatacacccagatggcctgaagtaactgaagaatcacaaaagaagtgaaaaggccctgccccgcctcaactgatgacattccaccatggtgatttgttcctgccccaccttaactgagtgattaaccctgcgaatttccttctcctggctcagaagctccccaactgagcaccttgtgacccccgcccctgcccaccagagaacaaccccctttgactgtaattttccattaccttcccaaatcctataaaacggccccacccctatctccctttgctgactctctttttggactcagcccgcctgcacccaggtgaaataaacagccatgttgctcacacaaagcctgtttggtggtcttttcacatggacgcgcatgaaa

SEQ ID NO: 271 - DNA, 122 bp, Homo sapiens
ggtagttagacaggcatgagcagagcaggagagagctctccccacccaccaggaatgtcaggaaatggttcggcaattatcatattgcctttctaaaagtgacaaattggcagcagtgacac

SEQ ID NO: 272 - DNA, 385 bp, Homo sapiens
gtcaggcctctgagcccaagctaagccatcatatcccctgtgacctgcacgtatacatccagatggcctgaagtaactgaagaatcataaaagaagtgaaaatggcctgtttctgccttaactgatgacattaccttgtgaaattccttctcctggctcatcctggcccactgagcaccttgtatcccccacccctgccagccagagaacaaccccctttgactgtaattttccactacctacccaaatcctataaaatggccccacccctatctcccttcactgactctcttttcagactcagcccgcctgcacccaggtgattaaaaagctttattgctcacacaaagcctgtttggtggtctcttcacacggacacgcttga

SEQ ID NO: 273 - DNA, 180 bp, Homo sapiens
aagaatcaggggagaagtaacgcaagaccccagaagtatgccaacatataaaaccccaagtcaaaaggtcaaaccacgcatttgatccctcaagtcccctgcttgaccctcttccaagtgtactttccttcctttcattcctgctctaaagctttttaatactttcactcctgctcaaaa

SEQ ID NO: 274 - DNA, 1463 bp, Homo sapiens
ccacaaaagaagtgaaacagtcagttcctgccttaactgatgacattccaccattgtgatttgttcctgccccaccctaactaatcaatcgacctcgtgacattcctcccctggacaatgtgtctcatgatctccccaccctgccccttgagacccccgcccctgcccataagagataaccacctttaactgtaattttccactacctacccaaatcctatagaactgccccacccctatctccctttgctgactcctttttcggactcagcccacctgcacccaagtgaataaagagcctcgttgctcacacaaagcctgtttggtggtctcctcacacagacgcatgtaacatttggtgctgaaacccaagacaggggactccttcagaagaccagccccctgtcctcaccctcagtccgggaggagatccacctacgacctcgggtcctcagaccagcccaaggaacatctcaccaatttcaaattgggtaagtgacctcttcactctcttctccagcctctcttgctacccttcaatctccctatccttccaactccagttctctttcctctctagtagaggcaaaggagacacattttatccacgaactcaaaaattccgatgtcggtcatggatttgggaagacagtcttcccttggtgtctgatcatagcggggacgcctgccttgatcattcacccacactccattggtggcaggtcaattgcagggacacctgctttggctgctcacccacattacagccgaggactcagtcagggatgcctactagaagcctggcagctgcctacctccatttctccgtgtctctaccttcctctttaaacttaccttccccactatgggcaagcttctgccatccattcctccctcttcccccttagcctgtgttcttaaaaacctaaaaccccttcaactaacacctgacctaaaacctaaacatcttatattcttctgtaataccgctgggccccaatacaaacttgacaatagttccaagtggtcagaggatggtaatttttatttgtctatcctacaagacctagataatttttgtcaaaaattaggcaaatggtctgaggtgccttacgtccaggccttttttacactttgctctctccctagtctctgctcccaatgtgacttatcccagattttccttctttctctcccgtccactccttcggtctccaccccaagctcagagtcctctgaatcctccttttccactgacccctctgacctctctcctcctcccccggccgctcctcgccgggctgaatcatgtcccaattcttccacagcctccactcccccacactataacccttctattacctcctctcctcacacctggtctggcttacagtttcgttccgtgactagctctcttccacctgaccaacaatttcctcttagagaggtggctggagctgaag

SEQ ID NO: 275 - DNA, 5245 bp, Homo sapiens
gtcaggcctctgagcccaagctaagccatcatatcccctgtgacctgcacgtacacatccagatggccggttcctgccttaactgatgacattccaccacaaaagaagtgaaaatggcctgttcctgccttaactgatgacattgttttgtgaaattccttctcctggctcatcctggctcaaaagctcccccactgagtaccttgtgacccccactctgaccgccagggaacaaccctccctttgactgtaattttcctttacctacccaaatcctgtaaaacggccccacccctttctcccttcactgactctcttttcggactcagcctgcctgcacccaggtgattaaaagcttttattgctcacacaaagcctgtttggtggtctcttcacacggaggcgcatgaaatttggtgccgtgactcggatcaggggacttcccttgggagatcaatcccctgtcctcctgttctttgctcgtgagaaagatccacgtacgacctcaggtcctcagaccgaccagcccagtaaacatctcaccaatttaaaatccggtaagcagcccctttttactctcttctccaacctccctcaccatccctcaacctctttctcctttcaatcttggcgccacacgtcaatctctcccttcttttaatttcaattcctttcattttctggtagagacaaaggagacacgttttatccctggacccaaaactccggcgctggtcatggactagggaaggcagccttcccctggtgtttaatcattccagggatgcgtccctgattattcacccaggtttcagaggtgtcagaccacgcagggatgcctgccttggtccttcacccttagcggcaagtcccacttttctggggaaagggcaagtaccccaaccccttctctccgtgtcttctccgcctttctggggggcaagaaacccccaaccccttctccttcaccctgagcggcaagtcctgcttttctagaggaggggcaaatactccaacctcatatctctgcgcctcgatcccttatttccgcacccggacctcttatatctctgcgccctgatcccttatttccgtgccccagcctcttatatctctgtgccccgaccccttatttccatgccccagcctcttatatctctgtgccccgatcccttatttccgtgccccagcctcttatatctctgtgccccgatcccttatttccgtgccccaacctcttatatctctgcaccccgatcccttatttccgtgccctgacctcgtatctctgtgccccaaccccttctctgcttttctggagggcaagaacccccaacccttctccgtgtctctactcttttctctgggctagcctccttcactatgggcaaccatccaccctccattcctccttcttctcctttagcctgtgttattaagaacttaaaacctcttcacctctcacctgacctaaaatctaagcgtcttattttcttctgcaatgccacttgaccccaatacaaactcgacagtagttccaaatagccagaaaatggcactttcaatttttccatcctgcaagatctaaataattattgtcgtaaaatgggcaaatggtctgaggtgcctgatgtccaggcactcttttacatgtcagtgcatctctagtctctgttcccaatgtaactcatcccaaatcttccttctttccctcccacctgtcccctcagtcccaaccccaagcttcgctgagtctttctaatcttccttttctacctctcccctcctggccaggctgagctaggtcccaattcttcctcagcctccactcctccaccctataatccttttatcacctcccctcctcacacccggtccggcttacagtttcgttccacctctagccctccggcacctgctcagcaatttactcttaaaaaggtggctgaagctaaaggcatagtcaaggttaatgctcctttttccttatcagacctctcccaaatcagtgtgcgtttaggctctttcatcaaatatgaaaaatccagcccagttcatggctcgtttggcagcaaccctgagacactttacagccctagaccctgaaaggtcaaaaggccgtcttattctcaaaatacattttattacccagtctgctcccgacattaaatacaactccaaaaattaaattctggccctcaaaccccacaacaggatttaattaacctcgccttcaacgtgtacaataatagaaaaaagttgcaattccttgcctccactgtgagacaaaccccagccacatctccagcacacaagaacttccaaacatctgaaacgcagcgaccaggcgttcctccagaacctcctcccccaggagcttgctacaagtgccagaaatctggccaccaggccaaggaatgcctgcagcccaggattcctcctaagccgagtcccatctgtgcaggacaccactagaaatcggactgtccaactcacctggcagccactcccagagcccctggaactctggccgaaggctctctgactccttcccagatcttcttggcttagcggctgaagactgatgctgtcggatcgcctcggaagccccctagaccatcagggacgccgagcttcgggtaactctcacagtggagggtaagtctgtccccttcttaatcaatactgaggctacccactccacattaccttcttttcaagggcctgtttcccttgcctccataactgttgtgggtattgacggccaggcttctaaacctcttaaaacccccactctcatgccaacttagacaatactcttttaagcactccttttagttatccccacctgcccagttcccttattaggccgagacactttaactaaattgtctgcttccctgactattcctggattacagctacatctcattgctgcccttcttcccaatccaaagcctcctttgcgtcctcctcttgtattaccccaccttaacccacaagtataagatacttctactccctccttggcgaccgatcatgcaccccttaccatctcattaaaacctaatcacccttaccccactcaatgccaatatcacatcccatagcatgctttgaaaggattaaagcctgctatcacttgcctgctacagcatggccttttaaagcctataaactctccttacaattcccccattttacctgtcctaaaaccagacaagccttacaagttagttcaggatctatgccttatcaaccaaattgttttgcctatccacctcatggtgccaaaccctatcctctctcctatcctcaatacctccctccacaatccattattctgttctggatctcaaacatgctttctttactattcctttgcacccgtcatcccagcctctcttcgctttcacttggactgaccctgatacccattaggctcagcaaattacctgggctgtactgccgcaaggcttcacagacagcccccattacttcagtcaagcccaaacttcatcctcatctgttacctatctcggcataattctcataaaaacacacgtgctttccttgctgatcgtatccgattaatctcccaaacctcaatcccttacaaaacaacaactcctttccttcctaggcatggttagtgtggtcagaattcttacacaagagccaggactgcaccctgtagcctttctgcgcaaacaactggatcttactgttttagcctagccgtcatgtctgcgtgcagcggctgctgccgccctaatacttttagaggccctcaaaatcacaaactatgctcaacttactctctacatttctcataacttccaaaatctattttcttcctcatagctgacgcatatactttctgctccctggctccttcagctgtactcactctttgttaagtcccacaattaccattgttcctggcccggacttcaatctggcctcccacattattcctgataccacacctgacccccatgactgtatctctctgatccacctgacattcaccccatttccccatatttccttctttcctgttcctcaccctgatcacgcttgatttattgatggcagttccaccaggcctaatcgccacacacaagcaaaggcaggctatgctatagtacaagccactagcccgcctcttagaagctctcatttcctttccatcatggaaatctatcctcaaggaaataacttctcagtgttccatctgctattctactactcctcagggattattcaggccccctcccttccctacacatcaagctcgaggatttgcccccacccaggactggcaaattagctttactcaacatgccccgagtcagataactaaaatacctcttagcctaggtagacactttcactggataggtagagtcctttcctacagggtctgagaaggccaccgcagtcatttcttcccttctgtcagacataactcctcagtttagccttcccacctctatacagtctgataacagaccagcctttattagtcaaatcagccaagcagtttttcaggctcttagtattcagtgaaacctttatatcctttatggtcctccgtcttcaggaaaagtagaatggactaaaggtcttttaaaaacacacctcaccaagctcagccaccaacttaaaaaggactggacaatacttttaccacttacccttctcagaagtcagacctgtcctcagaatgctacaaggtacaggccatttgagctcctgtatagacgctcctttttattaggccccagtctcattccagacaccagatcaacttagactgtgcccccaaaaaacttgtcattcctactatcttgtgtctagtcatactcctattcaccgttctcaactactcatgcatgccctgctcttgtttacactgccggtttacactgtttctccaagtcatcaaagctgatacctcctggtgctatccccaaactgccactcttaactcttgaagtaaataaataatctttgctggcaggactatgctgaacctccttaggcactctctaatcagatgtcctgagtcgtcccaattcttagaccttttatacctgtttttctccttctcttattccatttagtttttcaattcatacaaaaccgtatccaggccatcaccaataattctaaattacaaatgttccttctaacaaccccacaatatcaccccttaccacaaaatcttccttcagcttaa

SEQ ID NO: 276 - DNA, 5661 bp, Homo sapiens
gagagacaggactagctggatttcccaggccgactaagaattcctaagcctacctggggaaggtgacctcacccacctttaaacatggggcttgtaactcagctcacacccgaccaatcaggtagtaaagagggctcactaaaatacaaattaggctaaaagcaggaggtaaaaaaaaaaacagtcaaatcacatatcacctgggagcacagggggagggacaatgattgggatatataccccaggcattcgagccagaagtgggcaaccccctttgggtcccctcccattgtatgggagctctgttttcactctattaaatcttgcaactgaacactcttctggtccatgtttgttccagctcgagctgagctttcactcactgtccactactgctgttcactgctgtcacagaccggccattgacttccacccctttggatccagcagggtatccacttcatttctgatccaggaaggcacccattgctgctcctgttcagactagaagacattgttactgtgcggctaagtgcctgggtttgtcctaacaaagctgaacaccagttgctgggttccatggttctcttccatgacccacagcttctaatagagctataacactcaccacatggcccaaggtttcattctttggaatctatgaggccaagaacctcaggtcagagaacaaaaggcttgctgccatcttgggagtggcaaccaccatcttgggagctctaagaacaaagacctgctggtaacatttggtggcctgtaaggggattctccaaagcagtgagtaatatcactccacttttgcttgctattctatcctgtccttccttagaattggaggaaaatatcagacacctgttggccagttaagaacaattagcgtggctgctgtactaaagattctggtatgaggcttcctgggaaaaggctttctaacaatgcccaacccttctgggttgggagaattggtctgcctggaaccagcttctgctttcacaattttcctggggaagccaagggttgactggaggcagaaagctgtcatcccaaacttccggcattggctggtcaagatcatggcacagccagaaatctctactcaacagtcgcccatatgtgcgcccttacctctccttctgatccatacctcctgggttctgaccatgactttcttgaaagtgtagccccaaaattatccttaccactgaatctacttcctccaatccctgcctcctggatgctaatgcttcagacttttgcttcctctcccaagtattagatcaggttgtatctccaaagggatctaaggaagttctacgctgtgtccttaggcacctaggctatgaacccagggagtcttgtcctggtgtccctccaaatttaagtatatagttctcaacatgggcagttatgtgggacccattccccaccacccttgccagggcccaagttctattataagccatgtccccaagtttgtaaatggctaggaggattgctcccccattgtgtaagatgctctcctcccccaatttctacccagcttacccctctgcagtataatctccaagccttggctccatggacagggccttagaactgatgacccagtactttaacaactggaactgggtctgcgacaaaataatacatcaggatgaaagcgaattgagtaaattaaagggatggcccaaatacattcaatctgtagcagcaactgctttgctaacagaagaaagtagaaaaataacgtttagaggaaacctcattgtgagcacacctcaccagttcagaacaatcctaagtcaaaaaaaaaaaaaagtaacttactaactcaaaaatcttaaagtatggggctattccatttgaaaaatgtgatttaacattaaccactgaaaattcccttaacccagcaggtttcctaacgagggatttagatcttaattaccatacaaagttttgaccagacctaggaggaactcccttcaggacaggagatagatggtgtcttccaggtgattgagggaaaaaaaccacgatgggtattcagtaattgatagggagactcttgtggaagcagagttaggagaattgcctaataattggtctgctcaaacatgcgagctgtttgcactcagccaagccttaaagcacttacagaatcaaaaaaactctatgtcaatcctgactcaaaaggttacctacaccctctctgaaacgaatttgcataagaacggttgtttatgggaatgcatcttgatggggtagctgggttgtcatgaaatactcaggaacccagcccagctctaggactcacccctgagcacaaaggcaatgttgagcatgctggtaaaggaccactagaatccagcagctgggacccctttctttgtggtcaagaaaggcaggaaaaggggtgcaggactgctacattgatgagtgtaattaatccgataagcagaggtccatgggtggttacgcaccctggaaaggaataagcattaggacaataaaggatgctctaggattaatgctcatcggaaaatgactagaggtgctggcatccctatattcttttttcagatgggaaacattccccctaaggcaaaaacgcccctaagatgtattctggagaattcggcccagtcagagtatatgtgcctttttccctgttagacttgaagcaaattaaaatagacctaggtaaattatcagatgatcctgatggctattttgatgcttttacaagggttaggacaatcctttgatctgacatggagagatataatgttactgctagatcagacactaaccccaaatgagagaagtgctgccataactgcagcctgagagtttggcaatctctggtatctcagtcaggtcagtgataggacctgtggcttcaaagaggacaacagaggaaagagaacaattccccacaggccagcaggcagtttccagtgtagaccctcattgggacgcagaatcagaacatggagattggtgctgccgacatttgctaacttgcgtgctaaaaggactaaggaaaactaggaagaagcctataaattattcaatgatgtccactataacacagggaaaggaagaaaatcctactgcctctctggagagactaagggaggcattgaggaatgatacctctctgtcacctgactctatcgaaggtcaactaatcttaaaggataagtttatcactcagtcagttgcagacattagaaaaaactttaaaagtccaccttaggcccagagtaaaacttagaaaccctatggaaattggcaatctcggttttttataatagagatcaggaggagcaggcagaacgggacaaatgggattaaaaaaaaagggggcaccaccactttagtcatggccctcaggcaagaggacttttgaggctctggaacagggaaagtctaggcaaatcaagtgcctaatagggcttgcttccacctcggtctacaaggacactttaaaaaagattgtccccttgttcgtgcccctttatgtcaagggaatcatggaaggcccactgccccaggagacgaaggacttctgagtcagaagccactaaccgaatgatccagcagcaggactgagggtacccggggcaagcgccagcccatgccatcaccctcacagaggtatgcttgaccattgaggcctagggggctaactgtctcctggacactggcacggccttctcagtcttactcccctgtcctggacaactgtcctctagatctgtcactatccgaggggtcctaggacaggcattcactagatacttctcccagacactaagttgtgactggggaactttactcctttcacataactttctaattatgcctgaaagccccactcctttgttaggaagaaacatcctagcaaaagcaggggctattatacactagaattaggagaaggaaaaaaggttaaatatatatacagactctaagtatgcttacttagtcctccatgcccacgcagcaatatggagagaaaaggaattcctaacttctgaggaaacacctatcaaacatcaggaagccattaggagaatattattgggtgtagagaaactaaagaggtggcagtcttacacttccggggtcatcagaaaggaaaagaaagctaaatagaagggaacctctaagcggatattgaagccaaaagagccacaaggtgggaccctccattagaaatgcttatagaaggaaccctagtatggggtaatcccctccaggaaaccaagccccagtactcagcagaagaaatagaatggggaacctcaagaggacatagtttcctcccctcaggatggctagccaccaaagaaggaaaaatacttttgcctgcagctaaccattggaaattacttaaaatccttcaccacacctttcacttaggcatttgatagcacccatcagatggccaaatcattatttactggatgaggacttttcaaaactatcaagtagatagtcagggcctgtgaaatgtggcaaagaaatattcaccgtcacttcaggccatacatatcaatccctgtatctttaacctccttgttaagtttgtctcttccagaatcaaagctgtaaaactacaaatcattcttcaaatggagccccagatgcagtccatgaccaagatctcccgccgacccctggactggccaactagcccgtgctccaatgttaatgacatcaaaggcacccttcctgaggaaatttcaactgcatgacccctactacgccccagttcagcaggaagcagttaagaactgtcatcggccaacctcctcaatagcacttgggttttcctgttgagagggcgtactaagagacaggactagttggatttcctaggccgactaagaattcctaagtctagctggggaaggtgacctcacccacctttaaacatggggcttgtaactcagctcacacccgaccaatcaggtagtaaagagggctcactaaaatacaaattaggccaagagcaggagataaagaaatagtcaaataatatatcacctgagagcacagggggagggacaatgattgggacatatacctcaggcattcgagccagaagtgggcaaccccctttgggtcccctcccattgtatgggagctctgttttcactctattaaatcttgcaactgaacactcttctggtccatgtttgttccagctcgagctgagcttttgctcaccttccaccactgctgtttgctgccgttgcagacccaccattgacttccaccactttggatccagcagggtgtccactgcatttctgatccagggaggtgcccattgctgctcccattcaggctagaggctcaccttttttcctgtgtggccaagtacccgggttcatcctaatcaagctgaacattagtcgctgggttccatggttcttttccatgacccacgccttctaatagagctataacactcacggcatggcccaaggttccattctttggaatctgtgaggccaagagcctcaggtcagagaacgaaaggcttgctgccatcttgggagccgccgccaccatcctgggagctctatgtgagctctaagaacaaagacctaccggtaacactaccttggc

SEQ ID NO: 277 - DNA, 942 bp, Homo sapiens
gtggggaaaaaaaagagagatcagactgttactatgtgtgtgtagaaaaaggaagacataagaaactccattttgatctgtactaagaaaaattgttctgctttgagatgctgttaacctgtaacttcagccttaaccgtgtgctcacagaaacatgtgctgtgtcttgttaacaatagatttgcaggcagcctgcttggtaaaagtcatcgccattctccattctccattaaccagggacaccatgcactgcggaaagccgcagggacctctgcccgagaaagcctgggtattgtccgaggtttccccccactgagacagcctgagatatggcctcatggagagggaaagacctgaccatcccccagcccgacacccataaagggtctgtgctgaggaggattggtaaacgagggaggtctctttgcagttgagataagaggaaggcctctatttcccgcatgtccccgggaatggaatgtctccatgtaaagccgaccattccttctattctgataggagaaaactgccctgtggctggaggcgagctatgctggcagcaatcctactctgttactcttcgctacactgagatgtttgggtaaagagaaacataactctagcctacgtgcacatccgggcacagtaccttcccttgaacttatttatgatgcagattcctttcctcacatgtcttcctgctgacattctccccaccatcaccctattctcctgccacactccccttgccaagatagtgaaaatagttatcaataaatactgacggaactcagagaccagcgctggtgcaggacctcacatgctgagtgtgccggtcccctggactcactattctttctctatactttgtctctgtgtcttatgtcttttctcagtctcttgtgtccacctgatgagaaatacccacaggggtggaggggc

SEQ ID NO: 278 - DNA, 589 bp, Homo sapiens
aataataattgatctcagccagcgccaagaaaaggcagtctcccaatagatagaaaacacccgaaactggtcatcagcagcttcctgataagatctcaggcattgggtgagtgggctcaagcatatgcactaagaggcaaagtggcagagtttaactggcacataatcttcctctaggaacactctaatagtaagagaaggacacctcaaatgagcatgtgcacatttcattaaacccactgtgtatgcagcccctcccaagtgctggcaggccactgtacatgtgggcagcccactccaagggaagaatcaagggagaagaaatacaaatcccagaaccatgtcaatgtataaaaccccaagtcaagggccggacagagcacttagatctctcaagtcgcccacttagccctcttccaagtgtactttacttcctttagttcccactttaaaactttaataaacatttactcctgctctaaaacttgcttgggtctctcactcttctgtatgccccttggccaaattctttcctccaaggaggcgagaatcaagttgctgcagacctgtatggattcgctcctgctaa

SEQ ID NO: 279 - DNA, 464 bp, Homo sapiens
gtcaggcctctgagcccaagctaagccattgcatccctgtgacctgcacctatacgcccagatggcctgaagtaactgaagaatcacaaaagaagtgaaaatggcccgttcctgccttaactgatgacgttccaccacaaaagaagcgaaaatggccagtccttgccttaactgatgacattaacttgtgaaattccttttcctggcttatcttggctcaaaaaatctcccccactgagcaccttgtgacccccactcctgcccaccaaagaacaacccccctttgactgtaattttcctttacctacctaaatcttataaaacgaccccaccccttcatagacccctatctcccttagctgactctctttgtggactcagcctgcctgcacccaggtgattaaaaagatttattgctcacccaaagcctgtttggtggtctcttcacacggacgtgagtgaaa

SEQ ID NO: 280 - DNA, 5700 bp, Homo sapiens
gtaaaaggatattaaccccagaggcaacaaaagaaattaaattagtggaagaaaaaattcagtcagcacaaataaatagatcccttagtctcactccaacttttgatttttgctactgcacattctccaacaggcatcattgttcaaaatactgatcttgtggagtggtcattccttcctcacagtacaattaagacttttacattgtacgtggatcaaatagctacattaattggtcagaaaaggttatgaatagtaaaattgtgtggaaatgacccagacaaaatagttgttcctttaaacaaggaacaggttagacaagcctttatcaattctggtgcatggcagattggtcttactaattttgtgggaattattgataatcattacccgaaaacaaaaatcttccagtttttaaaattgactacttggattctacctaaaattaccagacataaacctttagaaaatgctctgacagtgtttactgatggttccagcaatagaaaagcagcttacacagggccaaaagagcgagtcatcaaaactcaatatcaattggctcaaagagcagagttggttgcagtcattacagtgttacaagactttgatcaacctattaatattgtatcagattctgcatatgtagtgcaggctacaaaggatgttgagacagctctaattaaatatagcatagatgatcagttaaaccagcagttcaatttattacaacaaactgtaaaaaaaaaagaaatttcccattttatgttactcatattcgaggacacactaatttaccagggcctttaactaaagcaaatgaacaagctgacttactggtaccatctgcattcataaaagcacaagaacttcatgctttcactcatgtaaatgcagcaggattaaaaaacaaatttcatgttgtagggtccagccccatagggtcggtgggtctctccccatgtgcagagatgagagagtgtagaaataaagacacaagacaaagagataaaagaaaaggcagctgggcccgggggaccactaccaccaatgcacggagaccggtagtggccccaaatgtcgggctgcgctgttatttattggatacaaagcaaaaggggcagggtaaagcgtgtaagtcatctccagtgataggtaaggtcacgtgggtcacgtgtccactggacagggggcccttccctgcctggcagccgaggcagagagagagaggagacaaagagaaagacagcttacaccattatttttgcatatcagagacttttagtactttcactaatttactactgctttctagaaggcagagccaggtgtacaggatggaacatgaaggcggactaggagcatgaccaccgaagcacagcatcacagggagacggttaggcctccggataactgcgggcgagcctgactgatgtcaggccctccacaagaggtggaggagcagagtcttctctaaactcccccggggaaagggagactcccttccccagtctgctaagtagcgggtgttttcccttgacacttatgctaccgctagaccacggtccgcctggcaacgggcgtcttcccagacgctggcgtcaccactagaccaaggagccctctggtggccctgtccgggcataacagaaggctcgcactcttgtcttctggtcacttctcactgtgtcccctcagctcctatctctgtatggcctggcttttcctaggttatgattatagagcgaggattattataatattggaataaagagtaattgctacaaactaatgattaatgatattcatatataatcatgtctatgatctagatctggtataactattcttgttttatattttattatactggaacagctcgtgtccttgctctcttgcctcagcgcctgggtggcttgccgcccacagatgtcacatggaaacaggcaaaaaatattctacaacatggtacccagtgtcaagtcctacacctgcccactcaagaggcaggagttaatcccagaggtctgtgtcctaatgcattatggcaaatggatgtcacacatgtaccttcatttggaagattatgatgtgtccgtgtaacagttgatacttattcacatttcatgtgggcaacttgccagacaggagaaagtacttcccatgtgaaaaaacatttattgtcttgttttgctgtcatgggagttccagaaaaaatcaaaactgacaatggaccaggatattgtagtaaagctttccaaaaattcttaaatcagtggaaaattacacacacaacaggaattccctataattctcaaggacaggccatagttaaaaaaaactaatagaacactcaaaactcaattagttaaagagaagggggagacagtaaggagtgtaccactcctcagatgcaacttaatctagcattctatactttaaatgttttaaacatgtatagaaatcagactactacctctgcagaacatcttactggtcaaaagaacagcccacatgaaggaaaactgatttgataaaaagacaacaacaataagacatgagaaatagggaaggtggtaacttgggggagaggttttgcttgtgtttcaccaggagaaaatcagcttcctgtttagatacccactagacatttaaagttctacaatgaacccatcagagatgcaaagaaaagcacctccacggagatggaaacaccacaatcaaacaccatcgattcacaaggtgaacaaaatggtgatgtcagaagaacagatgaagttgccatccaccaagaaagcagagccgccgacttgggcacaattaaagaagctgacacagttaccaaaaaaaagcctagagaacacaaaggtgacacaaactccagagaacacgctgcttgcagctttgatgattgtatcaacggtggtaagtctccccttgcctgcaggggcagctgcagctaattatacctactgggcctatgtgcctttcccgcccttaattcgggcagtcacatggatggataatcctattgaagtatatgttaataatagtgcatgggtacctggccccacagatgatcgttgccctgccaaacctgaggaagaaggaatgatgataaatatttccactgggtatcgttatcctcctatttgcctagggagagcaccagcatgtttaatgcctgcaatccaaaattggttggtagaagtacctactgtcggtaccaccagtagattcacttatcacacggtaagtggaatgtctctcaggccacaggtaaattatttacaggacttttcttatcaatgatcattacaatttaggcctaaacaaaagccttgccccaaggtaattcccaaagaatcaaaaggcacagaagttttagtttgggaagaatgtgtggccgatagtgcggagatattacaaaacaatgaattcggaactattatagattggacatgtcgaggtcaattctaccacaattgcacaggacaaactcagtcatgtcccagtgcacaagtgagtccagctgttaacagtgacttaacagaaagtttagacaaacataagcacaaaaaattacagtctttctaccctttggaatggggagaaaaaggaatctctactccaagactaaaaataataagtcttgtttctggtcctgaacatccacaattatggatgcttactgtggcctcatattgcattagaatttgatctggaaatcaagctatataaagaagagatcgcaagccattttatactatcgacctaaattccagtctaacagttcctttgcaaagttgtataaagcccccttatatgctagttgtaggaaatatagttattaaaccagactcccaaactataacctgtgaaaactgcagattgtttacttgcattgattcgacttttaattggcagcaccatattctgctagtgagagcaagagaaggcgtgtgggtccctgtgtccatggactgaccgtgggaggcctcgccatccgtccatattttgactgaagtattcaaagccattttaaatagatccaaaatattctttaattgcagtgattatgggactaattgcagtcacagctacggcctctgtggcaggagtttcattgtactcttctgctcagacagtaaacttttttaattattggcaaaagaattctacaagattgtggaattcataatctggtattgatcaaaaattggcaaatcaaattaatgaccttagacacaatgttgtttggatgggagataggctcacgagcttgaaacatcatttctggttacactgtgactggaatatgtcacatttttgtattacatcctaagcctataatgagtctgagcatcattgggacatggttagatgccatctacaaggaagagaagatgatcttactttagacatttcaaaattaaaagaaaaatttttgaggcatcaaaaacccatttaaatttggtgccaggaactgaggcaatcgcgaaagctgctgatggcctcgcaaatcttaacccggtcacttgggttaaaaccatcgcaagttccactattgtaaatttcatattaatccttgtgttcctgttctgtctgttgttagtctgcaggtgtacccagcagctccgaagagacagcgaccattgagaatgggtgatgacgacgatggtggttttgtcaaaaagaaaagggggaaatgtggggaaaagaaagagagatcagactgttactgtgtctatgtagaaaaggaagacataagaaactccattttgatctgtattaagaaaaattgttctgctttgcgatgctgttaatctgtaactttagccccaaccctgtgctcacagaaacatgtgctgtattgaatcaaggtttaatggatttagggctgtgcagggtgtgccttgttaacaatatgtttgcaggcagtatgcccggtaaaagttatcgccattctccattctctgttaaccagggacacaatgcactgcggaaagccgcagggacctctgccctagaaagcctgggtattgtccaagtttccccccactgagacagcctgagatatggcctcatgggaaaagaaagaccttatatcccccaacccgacacccgtgaagggtctgtgctgaggaggagtagtgaaagagggaggcctctttgcagtcaagataagaggaaggcttctgtctcctgctcatttctgggaatggaatgcctcggtgtaaagccgaccattcattctattctgaggtaggagaaaaccgccctgtggttggaggtgagacatgctggcagcaatactgctctgtgactctttgctacactgagatgtttgtgtgaagagaaacataaatctagcctacgtgcacatccaggcacagtacctttccttgaacttattcatgacacagattcctttgctcacgtttccctgctgaccttctcgccaccatcaccctgttgccctgccacactcccctcacaaagatagtaaaaatagtgatcaataaatactgagggaactcagagaccagcgccggtgcgggtactcgcacactgagctccggttgtctgggcccactgctgtttctctatactttgtctctgtgtcttatttcttttctcagtttctcatctccacctgatgagaaacacccgcaggtgtggaggggcaggcccccttca

SEQ ID NO: 281 - DNA, 8561 bp, Homo sapiens
accagggtcagagggactgcttcaagagaccagttccctgtcctcaccctcactctgtgaagagatccacctacaacctccggtcctcagaccaaccagcccaaggaacatctcaccaatttcaaatcaggtaagcggtcttttcactctcttctccagcctctctcactcccttcaatctctctttccttccaattccagttgttttcctctctagtagagacagaggagacacattttatctgtggacccaaaactccggcgccagtcacggactcgggaagacagtcttcccttggtgtttaatcactgcggggacccctgcctgattattcacccacattccattggtgtctgatcaccgcagggatgcctgccttggtcattcacccacattcccttggtggcaagtcaattgcagggatgcctgctttggctgctcacccacattgcagcccagggctgctccccaccccccttctccgtgtctctacccttctctttaatcttgcctccttcactatgggcaaccttccaccctccattcctccttcttctcccttagcctgtgttctcaagaacctaaaacctcttcaactctcgcctgacctaaaatctaagcatcttattttcttttgcaacactgcttggccccaatacaaacttgacaatggttctaaatggccagaaaacggcacttttgatttctccatcctacgagacctagatcatttttgtcgaaaaatgggcaaatggtctgaggtgccttacatccaggcatttttcacacttcattctctccctagtctctgttcccaatgcaactcatcccaaagcctccttctttccctcctgcctgtcccttcagtcccaaccccaagtgtcactgagtcttgtgaatcttccttttttactaacccatctgacctctcacctcctccccagactgctcctcctcaggtcgctccccgtcaggctgaatcaggctccaactcttgttcagcccctgctcccctaccctataacccttctattacctcccctccccacacccggtctggtttacagtttcattctgcaactagctctcccccacctgcccaacaatttcctcttagagaggtggctggagttgaaggcatagtcagggtacatgtgcctttttctctatcagacctttcacaaatcagccagtgtttaggctctttctcatcagaccccactaaatatatacaggaattccgatatctaactctgtcctacaatttaacttagagtgacttaaatgtcatcctgacttctaccctctccccagatgaacgggaaagagtttttttctgtagcccaatctcatgctgataaccaccagcttcatgagccagacctccaggaaggcattagagcagttccccgagaagatccccaatggaactaccaggcagattccccaggtatagctaggcgagattacatggtttcctgcctagttgaagggctttaaaaggcagcttataagctgttaattatgacaaacttaaagaaactacccaaggtaaagacgaaaacccagcccagttcatggcccgcttaacagcaacccttagacgctttaccgccctagacccagagggtccagaaggccgccttattcttaacatgcattttatcacccagtcagctcctgacattagaaaaaagctttaaaaattggaatccggccctcaaaccccacaacaggaattaatcaacctcaccttcaaggtgtacaataatagagaggcggtagccagacagcaatgcatttctgagttacagctacttgcttccaatgtaagataacccacaaccacggctccagcatataagaacttcagaacatcaaagccatagctcccaggggctccttcaaaacatcctcgtggaccttgcttcaaatgccaaaagcctggccactgggcctcagaatgcccgcagcccaggattcttcctaagacatgccctgtctgtgtgggtccccactggaggttggactctccgactcacatcgccgctgcttctaaagcctctggagcccaaacccagtgttccctggctgactccttcccagatctcctcagcttagcagctgaagactgactctgcctgatcacattggaagccccctggaccatcacggacgccgagctttaggtaactcttatggtggagggtaagtccgtcccctatttaattgatatgggggctacccactccacattaccttcttttcaagggcctgttttccttgcccccataactgttgtgggtattgacagccaagcttcaaaaccccttaaaactaccccactctggtgccagcttggacaacattcttttatgcactctttttcagttatccccacctgtccagttcccttattaggtcaagacattttaaccaaattatctgcttccctgattattcctggactacagtcacatcttatctccacccttcttcccaacccaaagcctccttcgtgtcttcctctcatatcccccaaccttaatccacaaatatgggacacctccactccctccctggcaactgatcacatgcccattactatcccattaaaacctaatcacccttaccctacaacaggctttaaggggattaaatcctgttatcacttgcttgctacagcatgggcttctaaaacctataaattctccttccaattctcccgttttacctgttcaaaaactagacaagtcttacaggttagttcaggatctgcaccttatcaaccaaattgttttgcctatccaccctgtggtgcccaacccatacactcttttgtcctcaataccttcctccacaactcactattccgttcttgatcttaaagatgtttttttcactcttcccctacacccctcatcccagcctctctttgcttttacctggactgaccctgacacccatcagtcccagcagcttacctgggctgtactgctgcaagcctccagggacagccctcattacttcagccaagctttttctcatgatttactttctttccactcctctgcttctcaccttattcaatatattgatgaccttctactttgtagcccctcctttgaatcttctcaacaagataccctcctgctccttcaacatttattctccaagggatatcaggtatccccctccaaagctcaaatttcttctctgttacctacctaagtatagttcttcataaaaacacatgtgctctccctgccaattgggtctgactgatctctcaaaccccaactccttctataaaacaacaactcctttccttcctgggcatggttggatactttcgcctttggatacctggttttgcatcctaacaaaaccattacataaactcacaaaaggaaacctagctgacctcataaatcctaaatcctttccccactcctgtttccattccttgaaaacagctttacagactgctcccacactagctctccctgactcatcccaacccttttcattacacacagctgaagtgcagggctgtgcagtcggaattcttacagaaggaccaggaccacgccttgtagcctttttgtccaaacaacttgaccttactgttttaggctggccatcatgtctccatgcggcggctgccaccaccctaatacttttagaggccctcaaaatcacaaactatgctcaactcactctctacagttctcataacttccaaaatctattttcttcctcacacctgacacatatactttctgctccccggctccttcagctgtactcactctttgttgtgtctcccacagttaccattgttcctggcccagacttcaatccagcctcccacattgttcctgataccacacctgacccccataactgtatctctctgatacacctggcattcactgcatttccccatatttccttctttcctgttcctcaccctgatcacacctggtttattgatggcagttccaccaggcctaattgccactcaccagcaaaggcagactatgctatagtatcttccacatctatcattgaggctaccactctgcccccctctactacctctcagcaagccgaactcattgccttcactcaagccctcactcttgcaaaggaattacgcgtcaatatttatactgactctaaatatgccttccatatcctgcaccaccatgctgttatatgggctgaaagaggtttccttactacacaaaggtcctccatcgtcaaagcctctttaataaaaatgcttctcaaggccgctttacttcccaaggaagctggagtcatacactgcaagggccaccaaaaggcatcagatcccattgctcagggcaatgcttatgctgataaggtagctaaagaagcagctagcattccaacttctgtccctcacggccagtttttctccttctcatcagtcactcccacctactctcccactgaaacttccatctatcaatctcttcccacacaaagcaaattgttcttggaccaaggaaaatatctccttccagcctcacaggcccattctattctattgtcatttcataacctcttccatgtaggttacaagctgctagcccgcctcttagaacctctcatttcctttccatcgtgaaaatctatccttaaggaaatcacttctcagtgttccatctgctattctactaatcctcagggattgttcaggccccctcccttccctacacatcaagctcggggattcaccctcgcccaggagtggcaaattgactttactcacatgccctgagtcaggaaactaaaatacctcttggtctgggtagacactttcactggataggtagaggcctttcccacggggtctgagaaggccaccgcggtcctatcttcctttttgtcagacataattcctcagtttggccttcccacctctatacagtctgatagtggatcggcctttactagtcaaatcacccaagcagtttctcaggctcttggtattcagtggaaccttcatacccctcaccgtcctcaatcttcaggaaaggtagaacagactaatggtcttttaaagacacacctcaccaagctcagcctccatcttaaaaaggactggacagtactttgaccttctgcccttctcagaattcgagcctgtcctcgagacgctacagggtgcagtccatttgaacttttatatggatgcactttcttactcggcccaaacctcatcccagacaccagccctctaggcaactatcttccagtcctccagcaggctagacaggacattcaccaggctgctaatcttctcttgcctactccagattcccagccatatgaagacaccctagctggacgatcagttcttgttaagaatctgacccctcaaactctacaacctcgatggacaggaccccacttagtcatctatagtactccaactgccatccacctgcaggaccctccccattgggttcactgttccagaataaagttgtatccatcagacagacagcctgatatcttctcttcctcctggaaattgcaagtactctcccctacttccctaaactcactcacatttctgaagaacagtaatgacccttatgagcctaatacatcccttcatttattaggtctatccatccttatgctactctttgcaacggggctttatgcagtcacccccactacttggactgcaccccaaaaaacttgtcatcccttctatattctgtctagccatactcctattcaccattctcaactactcataaatgacctgctcttgtttacactgccggtttacattgtttctccaagccatcacagctgatatctcctggtgctatccccaaaccgccactcttgactccctcttggagtggatagatgatcttttctgacagggcaccctccaatacttccgccctgatgaagttctatcctttacttttatactcactcttattctcattcccattcttatgccactctctacctctccctagttacctccagcatactagcaatctcatccactttgtcctcactgccgccaatccttctctagcaaagaattgttggctatgcatttccctttcttcctgctcttacacagccatccccgctctacaggccgactgggctacctctcccacctccctgcacctcagaacctcctttaatagccctcactttacccgcctgaggaacttctttactttctagacagatttggtgagaactccccagacatttcacatcaataagctgtcacacttctccgcatctacttacggcacctttctccttatgtcaattccacgcccccatatttggactgctaaccacgcaaacaactatccctgttgccactcctttatgcatctctcgacaacagcctactggaatccctttaggcaaccttccactgtccaaatgttcctttactctttatctccagaacccagccacacacattaccaaacagatgggagcattccaacttcacgttactgataagccctctatcattactgacaaactgaaaaacattggcagtcactattgtttaggaagacacctaccctgcatctcactgcatccttcgctaccctccccctgctcatctgaatctcctcctagcccctcctcttgcttgcttatacccagccccatgaatagcagtgaaaggttacttgtagacactatgcactttctcatataccatgaaaaccgaacccctccctctatgcagttgcaccatcaatccccattacaatctgtaacagctgctgcccttgctggatctctaggatttggggtgcaggattcctctttcagtacaccctctaaccttttcactttacatttccagttctgcctgacacaaggtctcttctttttatgcggctcttccacctacatgtgcctacctgccaactggacaagcacatgtactctagtcttccttacccccaaaatccagtttgcagatgggaatgaacaactgcgggtccccctcatgacgccaacacgaccaaaaagagtcatccgactaatccctttacttgtgggtctacgactttctgcttccactattgtacttggaacttgaatagcaggcatttcaacctctgtcacaacattctgcagcctctctaatgacttctccactagcattacagatgtatcacaaactttatctgttcctcaagcccaggttgaccctttagctgcagttgtcctccagaaccgccaaagccttgatttactcactgctgaaaaaggaggactctgtatatttttaaatgaagagtgttgtttttacctaaatcaatctggtctggtatatgacaacataaaaaaactcaaggatagagcccaaaaactcaccaaccaagcaaacaataacattgaacccccttggacactctttaattggatgtcctgggtactcccaactcttagtcctttaatacctttttatctccttcttttattcagaccttgtgtctttcgtttagtttctcaattcatacaaaacagcatccaggccatcaccaataattctatatgacaaatcctccttctaagaaacccacaatatcacccctcaccccaaaatctttcttcagttgaatctttcccactgtaggtttccacacagcccctaatcccgcttgaagcagccctgagagacattgcccattatctctccataccacctccaaaattttttgccgctccaacacctcaccactattttgttttgcttttcttattaatataagaagacaggaatgtcaggcctctgagcccaagctaagccatcatatcccctgtgacctgcacatatacatccagatggcctgaagcaactgaagatccacaaaagaaatgaaaatagccttaattgatgacattccaccattgagatttgtttctgccccagcctgactgatcaatgtacttcgtaatctcccccacccttaagaagtttctttgtaattctccccatccttgagaatgtactttgtgagatccaccccctgcctgcaaaacattgctcctaactccaccacctatcccaaaacctgtaagaactaatgatatggccaggcgcggtggctcacgcctgtaatcccagcactttgggagaccgaggtgggtggatcacgaggtcaggagatcgagaccatcctggctaacatggtgaaaccccgtctctactaaaaattcaaaaattagccaggcaaggtggcgagcacctgtagtcccagctactcaggaggctgaggcaagagaatggcgtgaacccaggaggcagagcttgtagtgagcagagattgcgccactgcactccaacctgggcaacagagtgagactccatctcaaaaaaaaaaaaagaatcccaccaccctttgctgactctcttttcagactcagcctgcctgcacccaggtgaaataaacagcctcgttgctcacacaaagcctgtttggtggtctcttcacacggacacgcgtga

SEQ ID NO: 282 - DNA, 5234 bp, Homo sapiens
gtcaggcctctgagcccaagctaagccatcatatcctctgtgacctgcacgtacatatccagatggccggttcctgccttaactgatgacattccaccacaaaagaagtgaaaatggcctgttcctgccttaactgatgacactgtcttgtgaaattccttcttctggctcatcctggctcaaaagctcccctactgagcaccttgtgacccccactctgccagccagagaacccccctttgactgtaattttcctttatctacccaaatcctataaaacggccccacccttatctcccttcgctgactctcttttcggactcagcccgcctacacccaggtgattaaaagctttattgctcacacaaagcctgtttagtagtctcctcacactgacgcgcatgaaatttggtgccgtgactcggatcaggggacttcccttaggagatcaatcccctgtcctcctgctctttgctccgtgagaaagatccacctatgacctcaggtcctcagaccgaccagcccaagaaacatctcaccaatttcaaatacagtaagtggcctctttttactctcttctccaacctccctcactatccctcaacctctttctcctttcaatcttggcgccactcttcaatctctcccttctcttaatttcaactcctttcattttctggtagagacaaaggagacacgttttatccgtggacccaaaactccggcgccagtcacggactagggaaggcagccttctcttggtgtttaatcatttcagggacacctctctgattattcacccaggtttcagaagtgtcagaccatgcaaggacgcctgccttggtctttcacccttagcggcaagtcccgcttttctggaggaggggcaagtagcccaaccccttctctccgtgtctctacccgcttctccgcctttctggggggcaagaaacccccaaccccttctccttcactcttagcggcaagtcccgcttttctagaggagaggcaagtacccgaaccccttctgtgtctctaccccttctccacctttctggggggcaagacacccccaaccccttctcctttacccttagcggcaagtcccgcttttctggaagtacaagtgccccaaccttgtatctcggcgccccaatccgttatatccacgctcctcccctcctccccaggctgctcctcgccaggccgagctaggtcccaattcttcctcagcctccgctcctccaccctacaatctttttatcacctcccctcctcacacccggtctggtttacagtttcattccgtgcatagccctcccccacctgcccagcaatttcctcttaaaaaggtggctgaagctaaaggcatagtcaaggttaatgctcctttttctttatcagacgtctcccaaatcagtgagcatttaggctctttcaccaaatatgaaaaacccagcccagttcatggctcgttcggcagcaaccctgagacgctttacagccctagaccctaaaaggtcaaaaggccgtcttattctcaatatacattttattacccaatccgttcctgacattaaataaaactccaaaaattaaattccggccctcaaaccccacaacaagacttaattaacctcaccttcaaggtgtacaataatagaggcagccaagtagcaacatatttctgagttgcaattccttgcctccactgtgagacaaaccccagacacatctccagcacacaagaactccaaacgcctgaaccgtagctgccaggggttcctccagaacctcctcccccaggagcttgctaaaagtgccagaaatctggccactaggccaaggaatgcccacagcccaggattcctcctaagccgtgtcccatctgtgcaggaccccactgaaaactggactgttcaactcacctggcagccacttccagagctcctggaactctagcccaaggctctctgactctttcccagatcttctcggcttagcagctgaagactgacactgccggatcgcctcagaagcctgcaggaccatcacagacgctctaggtaactctcacagtagaaggtaagtccgtccgcttcttaatacggaggctacccactccacattaccttattttcaagggcctgtttcccttgcttccataactgttgtgggtattgacggccaggcttctaaacctcttaaaactccccaactctggtgccaacttagacaatactcttttaagcactccttttagttatccccacctgcccagctcccttattaggccgagacactttaactaaattatttgcttccctgactattcctaggctacagccacacctcattgctgccttttcccccagttcaaagcctccttcacatcctccccttgtagctccccaccttaacctgcaagtataagacatctctactccctccttagcgaccgatcatgcaccccttaccatcccattaaaacctaatcacccttaccccgctcaatgccaatatcccatcccacagcatgctttgaaaggactaaagcctgttatcactcacctgttacagcatggccttttaaagcccataaactctccttaccattcccccattttacctgtcctaaaaccagacaaggcttacaggctagttcagaatctgcgccttatcagccaaattgttttgcctatccaccccatggtgccaaacctatatactctcctcaatacctccctctacaacccattattctgttctagatctcaaacatgctttctttattgcacccttcatcccagcctctcttcgctttcgcttagactgaccctgacacccattaggctcagcaaattacctgggctgtactgccgcaagacttcacagatagcccccattacttcagtcaagcccaaatttcttcctcatctgttgcctatctcagcataattctcgtaaaaacacacgtgctctccctgctgatcgtgtccgattaatctcccaaacctcaatcccttacaaaacaacaactcctttccttcctaggcatggttagtgcggtcagaattcttacacaagagccaggaccgcaccctgtagcctttctgtccaaacaacttgaccttactgttttagcctagccctcatgtctgcatgcagcggctgccgctgctttaatactgttagaggccctaaaaatcacaaactatgctcaactcactctctacatttctcataacttccaaaatctattttcttcctcacacctgacgcatatactgtctgctccctggctccttcagctgtactcactctttgttaagtcccacaattaccattgctcctggcgcagacttcaatctggcctcccacattcttctagataccacacctgacccccatgactgtatctctctgatccacctgacattcaccccatttccccatatttccttctttcctgttcctcccccgatcacgcttgatttattgatggcagttccaccaggcctaatcgccacaccagcaaaggcaggctatgctatagtacaagccactagcccgcctcttagaatctctcctcattttctttccattgtggaaatctatcatcaaggaaataacttctcagtgttccgtctgctattctactactcctcagggattattcaggcccccttccttccctacacattaagctccaggatttgccccacccaggactggcaaattagctttactcaacatgccccgagtcagataactaaaatacctcttagtctaagtagacactttcactagataagtacaggcctttcctacaaggtctgagaaggccaccgcagtcattccttcccttctgtcagacataattcctcagtttagccttcccacctctatatagtctgataacagaccagcctttattagtcaaatcagccaagcaatttttcaggctattagtattcagtgaaacctttatatcccttatggtcctccgtcttcaggaaaagtagaatggactaaaagtctttcaaaaacacacctcaccaagctcagccaccaacttaaaaaggactggacaatacttttaccactttgccttctcagaagtcagacctgtcctcagaatgctacaaggtacagcccatttgagctcctgtatggttgctcctttttattaagccccagtctcatgccagacaccagaccaacttagactgtgcccccaaaaaacttgtcatccctactatcttctgtctagtcatactcctattcaccgttctcaactactcatacatgccctgctcttgtttacactgccggtttacactgtttctccaagacatcacagctgatatctcctgatgctatccccaaactgccactcttaactcttgaagtaaataaataatctttgctgacaggactatgctgaatctccttaggcactctctaattagatgtcctaggtcctcccaattcttagacctttaatacctgtttttctccttctcttactccgtttagtttttcaattcatacaaaactgtatccaggccatcaccaataattctaaatgacaaatgtttcttctaacagtctcacaatatcaccccttaccacaaaatcttccttcagcttaatctctcccactcccactctaagttcccatgccgcccctaatcccgttcaaagcagccctgaaaaacatcgcccattatctctccataccacccccaaaaattttcactgtcccaacactttaccactattttgttttatttttcttattaatataagaagacaggaatgtcaggcctctgagcccaagctaagccatcatatcccctgtgacctgcacgtatacatccagatggctggttcctgccttaactgatgacattccaccacaaaagaagtgaaaatggcctgttcctgccttaactgacgacattgtcttgtgaaattccttctcctggctcatcctggctcaaaagctcccctactgagcaccttgtgaccccccactctgcccgccagagaacaacccccctttgactataattttcctttacctacccaaatcctataaaacggccccacccttatctcccttcgctgactctctttttggactcagcccacctgcacccaggtgattaaaagctttattgctcacacaaagcctgtttagtagtctcttcacacagatgcgcatgaaa

SEQ ID NO: 283 - DNA, 5398 bp, Homo sapiens
ccctttgggtcccctcccattgtatgcgagctctgttttcacttattaaatcttgcagctgcacacttttctggtccgtgtttgttcctgctcgagctgagctttcactcactgtccaccactgctgtttgccgccgtcgcatacccgccattgacttccacccctccggatctggcagggtgtctgctgcatttctgatccagcgaggcacccattgccgcttccgtttgggctagaggcttgccattgttcctgcacggctaagtgcaggaatttgtcctaatcaagctgaacactagtcactgggttccacggttctcttctgtgacccacggcttctaatagagctataacattaaccgcatggaccaaggttccattccttggattccgtgaggccaagaaccccagatcagagaacaaaaggcttgcttccatcttgggagtggccgccaccatcttgtgagctctaagaacaaagacccacctgtaacatttggtggcaaccgtatggtgattctccaaagcggtgagtaatattggaccactttggcttgctattctgtcctatccttccttagagttggaggaaaatactgggcacctgttggccagttaaaaacgattagtgtggctgccggacttaagactcaggtgtgaggcttcctggggaaaggctttctaacaacccccaacccttctgggttgagagcattggtctgcctggaagcagcttccactttcacagtttcctgggggaagccaagggctgactagaggcagaaagctgttgtcccgaactcctggcattggctggttgagatcatggcgcagccagaagtctctactcatcagttgcccatgtgtgcacccctacctctccttctgacccatacctcctgggtcctgaccacaactttcttgaaagtgtagcccccaagttctccttacctctgattctactttctctgatccctgactcctagatactaatgcttcagactttcacttcctctcctaagtattagagcaagtggtatcttcaaagggatccaaggaagctctatgtggtgtccttaggcaactaggctatgaacccagggagtcttgtccctggtgcccctcccaatttaggtatatagctcttgacatggacagttatgtgggacccattcctcaccacccttgccagggccccaagttctattctgagctgtggccccaagtttgtaaatggctatgaggattgctctcccattgtgtaagatgctctcctcccccaattgctaccctgcttacccctctgcaatacaatctccaagccttggcttcttggccaggaccttagaactgataacccagtactttaacaaacggaactaggtctatgacaacatgatagatcaggatgaaagtgaattgagtaaattaaagggagatgcatattcctatagtggcaaatgggggcaatgagcgaacatccttctgctgtgttcccaaaatccatctacaaaaagagagagaggaaagagagaaagaaaagagggaaaaagggaaaagagagaggggaaagagagagagaaaaagagagagaggaaagaaagaggaaaagagggagtcaaagaaagaggagagagaggggagagagaggggaaagagagagagaggaaagagagagaggggaaagagaaaggcagagacagaaagagagagataaaagtagtaaagaaaaaaacagtgcaccctattcctttaaaagccagggtaaatttaaaacctacaattgataattgaacatcttctctgtgaccctgtaacactccaataccaccttgttgtcagtataaacaagggcatagcccaaaagcactgaggacactgacaatcagtagccttcctatcaaaaatccttaacccagtaacccacggatggcccaaatgcatttaatctgtagaggcaactgctttgctagcagaagaaagtagaaaaataacttttagaggaaacctcattgtgagcacacctcagaactatcctaagtaaaaaaagcagaaaggtagcttactaactcaaaaatcttaaagtatggggctattccgttagaaaaagatgacttaacattaaccactgaaaatttccttaacctggcagatttcctaacaggggatttaaatcttaactaccatacaaaagtccgaccagacctaggagaaactcccttcaggacaggatgatagatggttcctcctgggtgattgaaaaaaaaaacaaaaaaccacaatgggtattcagtaactgatagggaaactcttatagaagcagttaggaaaattgcctaataattggtctgttcaaaggtacaagctgtttgcactcagccaagccttaaaatacttacagaatcaagaaactctatctcaatcctgactcaaaaggttacctacaccccctctgaaacaaatttgcataagaattgttgtttatgggaatgcatcttgatggggcagctgggttgttatgaaatactcaggaacccagcccagctctagaactcacccctgagcacaaaggcaatgttaggcatggtggtaaaggaccactagaatccagcagcccagacccctttctttgtggtcaagaaaggcgggaaaacaggtgtaggactgctacatcggtgagcgtaactaatccgataagcagaggtccatgggtggttatgcaccctggaaaggaataagcattaggaccatcaaggatgctctatgactaatgctcattggaaaatgactagggctgctggcatccatatgttcttttttcagatgggaaacgttccccgcaaggaaaaactccactaagatgtattctggagaatttggcccagtcagagtgtatgtaccttttaccctgtcagacttgaagcaaactaaaatagacctaggtaaattctcagataactctgatgactatattggtgttttacaagggttaggacaatcctttgatctgacatggagagatacaatgttactgctagatcagacactaaccccaaatgagagaagtgccaccataactgtagcccaagagtttggcgatctctggtatctcagtcaggtcaataataggatgacaacagaagaaggagagcaattcctcacaagccagcaggcagttcctagtgtagactctcactgcgacacagaatcagaacatggatattggtgccacagacatttgctaacttgcgtgctagaaggactaaggaaaactaggaagaagcctataaattattcaatgatgtccactgtaacacagggaaaggaagaaaatcctactgcttttctggagagactaagggaggcattgaggaagcgtatctctctgtcacctgactctactgaaggtcaactaatcttaaaggataagtttatcactcagtcagttgcagacattagaaaaaacttcaaaagtccaccttaggcccgcagcaaaacttagaaaccctattgaacttggcaaccttggttttatataatagagatcaggaggagcaggcagaacgggacaaatgggataaaagaaaaaaggccaccgctttagtcatggccctcaggcaagtggactttggaggctctggaaaagggaaaggctgggcaaatcaaacgcttaatagggcttgcttccagtgcggtctacaaggacactttaaaaaagattgtctgaatagaaataagccgccccctcgtccatgccccttatgttaagggaatcactggaaggcccactgccccaggggacgaaggtcctctgagtcagaagccactaactagatgatccagcagcaggactgagggtgcccggggcaagcgccagcccatgccatcaccctcacagagccccgggtatgcttgaccattgagggccaagacgctaactgtctcctggacactggcgcagccttctcagtcttactctcttgttccagacaactgtcctccagatctgtcactatccgaggggtcctaggacaggcagtcattagatacttctcccagccactacttgtgactggggaactttactcttttcttatgcctttctaattatgcctgaaagccccactcctttgttagggagagacatcctagcaaaaccaggggccattatacactagaattaggagaaggaaaaagggtaaatatatatacagactctaagtatgcttacctagtcctccatgcccacgcagcaatatggagagaaagggaattcctaacttctgagggaactcctatcaaacatcaggaagccattaagagattgttattggctgtacagaaacctgaagagatggggtcatcagaaaggaaaacaaagggaaatagaagggaaccggcaagtggatattgaagccaaaagagccacaaggcgggaccctctgttagaaaagcttatagaaagacccctagtatggggtaatcccctccaggaaaccaagccccagtactcagccgaagaaatagaatggggaccctcacaaggacatagtttcctcccctcaggatggctagccaccaaagaaggaaaaatacttttgcctgcagctaaccagtggaaattacttaaaatccttcaccaaaccttttactcagacattgatagcacccatcagatggtcaaatcatttactgggccaagcctttgcaaaactatcaagggcctgtgaagtgtgccaaagaaataatcccctacacttcaggccatacatttcaatccctgtatctttaacctccttgttaagtttgtctcttccagaatcaaactgtaaaactacaaatcgttcttcaaatggagccccagatgcagcccatgactaagatctaccgtggactgctggactggcctgctagcccatgctccaatgttcatgacatcgaaggcacctctccagaggaaatctcaactgcatgacccctattacaccccaattcagcaggaagcagttagagcggtcgtcaggcaacctccccaacagtacttgggttttcctgttgagaaggggaactgagagacaggactagctggatttcctaggtcgactaagaattcctaagcctagctggggaaggtgacagcacctacctttaaacatggggcttgtaactcagctcacacctgaccaatcaggtagtaaagagggctcactaaaataccagttagactaaaagcaggaggtaaagaaatagtcaaatcatgtatcgcctgagagcacagggggagggacaatgatcgggatataaacccaagcatttgaactggcggtggaaaccccctttgggtctcctcccattgtatgggagctctgttttcactctatgaaatcttgcagctgc

SEQ ID NO: 284 - DNA, 965 bp, Homo sapiens
gtggggaaaagaaagagatatcagactgttactgtgtctatgtagaaagaagtagacgtaagaggctccattttgttctgtagtaagaaaaattcttttgccttgagatgctgttaatctgtaaccctatccccaaccctgtgctcacagaaacaagtactgtgtcgactcaaggtttaatggattcagggctgtgcaggatgtgctttgttaaacaaatgcttgaaggcagcatgcttgttaaaagtcatcaccactccctaatctcaagtaagcaggggcacaaaacactgcagaaggccgcagggacctctgcctaggaaagccaggtattgtccaaggtttctccccatgtgacagtctgaaatatggccttgtgggaaggaaaagacctgaccgttccccagcccgacacccgtaaagggtctgtgctgaggaggattagtataagaggaaggaaggcctctttgcagttgagataagaggaaggcatctgtctcctgatcgtccctgggcaaaggaatgtgtaaaacccaattgtatattccatctactgagataggagaaaactgccttagggctggaggtgggacatgctggtggcaatactgctctttaatgcattgagatgtttatgtatatgcacatcaaagcacagcacctttttcttaaccttgtttatgacacagagacatttgttcacgtgttttcctgctgaccctctccccactattaccatattgtcctgctacatccccctctctgagatggtagagataatgatcaataaatactagggaactcagagactgatgccagcgtggggcctctgtatgctgagcgcaggtcccctgggcccacttttctttctctatactttgtctctgtgtctctttcttttctcagtctcttgtcccacctgatgagaaacacccacagatgtggaggggcaggccgctccttca

SEQ ID NO: 285 - DNA, 418 bp, Homo sapiens
gtcaggcctctgagacaaagctaagccatcatatcccctgtgacctgcacgtacacatccacatggccggttcctgccttaactgatgacattccaccacaaaagaagtgaaaatggcctgttcctgccttaactgatgacattaccttgtgaaatcccttttcctggctcatcctggctcaaaagctccccaactgagcaccttttgacccccaccactgcctgccagagaacaaccccctttgactgtaattttcctttacctacccaaatcctataaaacggccccaccccatctcccttcactgactctcttttcggcctcagcccgcctgcacccaggtgaaataaacagccttgttgctcacacaaagtctgtttggctgtttggtggtctcttcacacggacgcgcacaaa

SEQ ID NO: 286 - DNA, 5382 bp, Homo sapiens
gtcaggcctctgagcccaagctaagccatcatatcccctgtgacctgcatgtatacatccagatggcctgaagcaacagaagatccacaaaatcactgaaaatagccttaactgatgacattccaccactatgatttgttcttgccccaccctaactgatacatatattctcccctgcccttaagaagatactttgtaatattctccccacccttcagaatgtgctttgtatgcctatcccaaacctataagaactaatgataatcccaccaccctttgctgactccttttttggactcagcctgcctgcacccaggtgaaataaacagccttgttgctcacacaaaggctgtttggtggtctcttcacacagacgtgcatgacatttggtgccaaaacccgggacaggaggactccttcgggagagcagtcccctgtcctcatcctcactccatgaggagatccacctatgaccttgggccctctgaccaaccagcgcaaggaacatctcaccaatttcaaatcaggtaagccgtctgttcactcttctccagcctctcttgctacccttcaatcttcctctctcgctacccttcaatctccctgtccttccaattccagttctttttcccctctagtagagacaaggagacacattttatccatggacccaaaactccggagccggtcacggacttgagaagacagtcttcccttggtgtttaatcactgcgaggacacctgcctgattattcacccacatttcattggtgtctgatcattgtggggatgcctgccttggtcattcacccacatttccttggtggcaagtcaattgcagggacgcctgcttaggctgctcacccacattgcagcccagggctgctcatccccaacccccttctccatgtctctaccctctcttttctctgggcttgcctccttcactatgggcaaccttccaccctccattcctccttcttctcccttagcctgtgttctcaaaaacttaaaacctcttcaactcacacctgacctaaaaccttaacatcttattttcttctgctatgccgcttggccccagtacaaactcgacaatagttccaagtagccagaaaacagcacttttgatttctccattttacaagacctggatgatttttgtcgaaaaatgggcaaatggtctgaggtgcctgacgtccaggcattcttttacacatcagtccctccctagtctctcctcccaatgcgactcgttccaaatctttcttctttctctcctgtctgttccttcagtctccaccccaagttctgagtcctttgaatgcttcttttctacggactcatctgacctctccccttctcctcaagctgctcgtcgccaggccgagccaggtcccaactcttcttcagcctccactcccccaccctataaccctcctattacctcccctcctcacgccaggtctggcttacagtttcattccacgactagccctccccaacctgcccaacaattttcttttagagaggtagctggagctgaaggcatagccaaggttaatgctcctttttctttatccaacctctcccaaatcagttagtgtttaggctctttttcatcaaatataaaaacccagcccagttcatggcccgtttggcaacaacccttagacactttactgccttagacccagagggcccagaaggccgtcttattctcaatatgcattttattacccaacccactcccgacattagaaaaagctccaaaaattagattctggccctcaaccccacaacaggacttaattgaccctgccttcaaggtgtgcaataagagagaagagttgcaattacttgcctctgctgtgagagaaaccccagccacatctccagcacacaagaacttcaaaacatctgaaccgcagtggccaggcattcctccaggatcgcctcccccaggagcttgctttaagtgctggaaatctggccactgggctgaggaatgcctgcagcccaggattcctcctaagctgcgtcccatctgtgtgggaccccactggaaatcggactgtccagctcacctggcagccactcccagagccgctggaactctggcccaaggctctctgactccttcccagatcttcttggctgagtggctgaagactgacactgcccgatcgcctcagaagcctcctggaccgtcacagacactttgggtaactcttacagtggagggtaagtccgtccccttcttaatcaatatggaggctacccactctacattaccttcttttcaagggcctgtttcctttgcctccataactgttgtgggtattgacggccagtcttctaaacctcttaaaactccccaactctgatgccaacttggacaacattcttttatgcactctttttcagttatcctcacctgcccagctcccttattaggtcaagacattttaactaaattatctgcttccctgactattcctaggctacagccacacctcattgccgcctttttccccagttcaaatctccttcacatcctccccttgtatctccccaccttaatccacaagtatgggacacctctactccctccttggcaaccgatcatgcaccccttaccatcccattaaaacctaatcacccttaccccgctaaatgccaatatcccatcccacagcacactttaaaaggattaaagcctgttatcatttgcctgctacagcctggccttttaaagcctataaactcccccttacaattcccccattttacctgtccaaaaactggacaagtcttacaggttagttcagggtctgtgccttatcaaccaaattgtcttgcctatccaccccgtggtgccaaacccatatactctcctatcctcaacatctcctccacaacccgttattctgttctagataaacctagttgaccccataaatcctaaatcctttccccactcccctttccattccttaaaaaacagccctaaaagctgctcccacactagcactccctaactcatcccaacccttttcattacacacagccaaagtgtagggctgtgtggtcagaattcttacacaagagccaggactgcaccctgtagcctttctgtcccaacaacttgaccttactgttttagcctagccctcatgtttgcatgcagtggctgccactgctttaatacttttagaggccctcaaaatcacaagctatgctccacttactctctacagttcccataactttcaaaatctattttcttcctcacacttaacgcatatactttctgcccccaagacccttcagctatactcactctttgttgagtcttccacaatcaccattgttgctggcccagacttcaatccggcctcccacattattcctgataccacacctgacccccatgactgtatctctctgatccacctgacattcattccatttccccatatttccttctttcctgttcctcaccctgatcacacttggtttattgatggcagttccaccaggcctaattgccactcaccagcaaaggcaggctatgctatagtatcttccacatttatcattgaggctactgccctgcccccctccactacctctcagcaagccaaactcattgccttaactcaggccctcactcttgcaaagggactacttgtcaatatttatactgattctaaatatgccttccatatccagtaccaccatgctgttatatgggcagaaagaaatttcctcactacataagagtcccccatcattaatgcctccttaataaaaactctgcttaaagctgctttacttccaaaggaagctggagtcattcactgcaagggccatgaaaagccatcagatcccattgctcagggcaacacttatgctgataaggtcgctaaagaagcagctagctttccaacttctgtccctcatggccagtttttctccttctcattggtcactcctatttactctcccactgaagtttccacctatcactccctctccactcaaggcagatggttcttaaaccaaaaaaatttgtatctccttccagcctcacaggcctgttgtattcataacctcttccatgtaggttacaagccattagcctgcctcttaaaacttctcatttcctttccattgtgaaaatctatccccaatccgccactcttgactccctcttggagtggatagatgatctttgctgacaggacacactccaacactttcaccctgatgaagtcctattctttacttttatactcactcttattctcgttcccgttcttatgccaccctctacctttccccagctatctccaccacactatcaatctcactcactctctcctagccatttctaatccttctttaacaaacaattgctggctttgcatttctctttcctccaaaatcaccgaggcctcgatttactcactgctgaaaaaggaggactctgtatatttttaaatgaagagtgttgtttttacctaaatcaatctggcctggtatatgtcaacattaaaaaaaactcaaggatagagcccaaaaactctccaaccaagcaaataattacgttgaacccccttggacactctctaattggatgtcctgggtactcccaattcttagtcctttaatacctatttttctccttcttttatttggaccttgtgtcttctgtttagtttctcaattcatataaaaaccacatccaggccatcaccaatcattctatacgacaaatgctccttctaacaaccccacaatatcaccccttaccccaaaatctttcttcagtttaatctctcccactctaggttcccacgctgaccctaatctcgctcgaagcagccctgagaaacatcgtccgttatctctccataccaccccaaaaaatgttcgctgtcccagcacttcaccactgtattgttttgtttttcttattaatataagaagacaggaatgtcaggcctctgagcccaagctcagccatcatatcccctgtgacctgcatgtatacatccagatggcctgaagcaacggaagatccacaaaatcactgaaaatagccttaactgatgacattccaccattgtgatttgttcctgccccaccctgatacatatattctcccctgcccttaagaaggtactttgtaatattctccccgcccttgagaatgtactttgtacgcctatcccaaacctataagaaccagtgataatcccaccaccctttgctgactcctttttcggactcagcctgcctgcacccaggtgaaataaacagccttgttgctaacacaaaggctgtttggtggtctcttcacacagatgcgtgtga

SEQ ID NO: 287 - DNA, 9314 bp, Homo sapiens
gtcaggcctctgagcccaagcctgcatgtatacatccagatggcccaaagtaactgaagaatcacaaaagaagtgaaaatggccatttcctgccttaactgatgacattaccttgtgaaattccttctcctggctcagaaattcccctactgagcaccttgtgacccccagccctgcccgccagagaacaaccccctttgactgtaattttccactacctacccaaatcctataaaactgcaccacccatatctcccttcactgactctctttttggactcagcccgcctgcacccaggtgattaaaaagctttattgctcacacaaagcctgtttggtggtctcttcacacggatgcgcatgacatttggtgccgtgattcggattgggggaccacccttggcagatcaatcccctgtcctcctgctctttgctccatgagaaagatccatctacaaccttgggtcctcagaccaaccagcccaaggaacatctcaccaattttaaatcaagtaagcggcctcttttactctcttctccaacctctctcactatccctcaacctctttctcctttcaatcttggtgccacccttcaatctctcccttctcttaatgtcaggccctttccttttctggcagagatagaggagacacattttatccatgaaaacaaaactctggcgccggtcacagactcgggaagacagtcttcccttggtgtttaatcactgcagagacacctgtctgattattcacccacgtttcagaggtgtctgatcatgacagggatgcctgccttgatccttcacctagtggcaagtaccactttccctgggtggtaagcaccaccttgcctggggggcaattgcccccgaccccttctctccatgtctctaccctctcttttctctgggcttgcctccttcactatgggcaaccttccatcctccattcctctttcttctcccttagcctgtgttctcaagaacttaaaacctcttcaactcacacctgacctaaaacctaaacaccttattttcttctccaatgccacttgacttcaatgcaaactcaacaattgttccaaatagccagaaaatggcactttcaatttttcggtcctacaagatctagataattcttgtcgtgaaatgggcaaacggtctgagatgcctgacgtccaggcattcttttacacatcggtccctccctagcctctgttcccaatgtgacttgtcccaaatcctccttctttccctcctacctgtcccctcagtcccaaccccaagcatcactgagtcttttcaatctttctcttctaccgacccatctgacctctcccttcctccccagactgctcctcctcaggttgctccctgccaggctgaatcaggctccaattcttcctcagcctccactccccaaccctataatccttctatcactgcccctcctcacacctggtctggcttacagttttgttccacgactagctctcccctacctgcccaacaatttcctcttaaagaggtggctggagctaaaggcgtagtcaaggttaatgctcctttttctttatccgacctctcccaaatcaattagcgtttaggctctttttcatcaaattaaaaaacccagcccagttcatggcccacttggcaacaacccttagatgctttaccgccctagacccagagggggcaaaaagccatattattctcaatatgcattttattacccgatccgctcccgacattaaaaaaaagccccccaaattaaattctggtcctcaaaccccacaacagaactttattaacctcgccttcaaggtgtacaataacagagaagagttgcaattacttgcctctgctgtgagagaaaccccagccacatctccagcacacaggaatttcaaaactcctaagccacagtggtcaggcattccttcaggacctcttcccccaggatcttgcttcaagtgctggctaatctggccactgggccaaggaatgcccgcagcctgggattcctcctaagccatatcccatctgtgcaggaccccactggaaatcggactgtccaagtcacctggcagccactcccagagcccctggaactctggcccaaggctctctgactgacttcttcccagatcttctcagcttaaaggctgaaggctgatgctgcctgatcaccttggaagcctcctggaccatcacagacgctttaggtaactcttacagtggaaattaaatccatcctcttcttaatcaatatggaggctacccactctacattgccttattttcaagggcctgtttcccttgcctccataactgttgtgggtattgacggccagacttctaaacctcttaaaactccccaattctggtgccaacttggacaacgttcttttaagcactcttttttagttatccccacctgcccagttcccttattaggctgacacattttaaccaaattatctgcttccctgactattcctggaccacagccacatctcattgctgcccttcgtcccaacccaaaacctccttcgtgtcttcctctcgcatccccccaacttaacccacaagtatgggacatctctactccctccctggcaaccaatcacacacttgttactatcccattaaaacctaatcacccttaccctgctcaatgccactatcccatcccacaacaggctttaaggggattaaagcctgttattgctcacctgctacagcatgggcttctaaaacctataaactctccttacaattcccccattttacctgtcccaaaaccggacaagtcttatatgttagttcaggatctgtgccttattgttttgcctatccatcttgtggtgcccaacctgtacactcttttgtcctcaataccttcctccacaactcactattctgttcttgatcttaaagatgcttttttcactattcccctgcacccattgtcccagcctctgtttgcttttatctggactgaccctgacacccatcagtcccagcagcttacctgggctctactgccgcaagccttcagggacagccctcattacttcagccaagctctttctcatgatttactttctttccacccctccacttctcaccttattcaatatatcgatgaccttctactttgtagcccctcctttaaatcttctcaacaagacaccctcctgcttcttcaacatttattctccaagggatatctggtacccccttccaaagctcaaatttcttctccatctgttacctacctcggcataattcttcataaaaacacatgtgctctccctgccgatcatgtccaactgatctctcaaaccccaaccccttctacaaaacaacaactcctttccttcctgggcatggttggatactttcgcctttggatacctggttttgccatcctaacaaaaccattatataaactcacaaaaggaaacctagctgaccccatagatcctaaatcctttccccactcctctttccattccttgaagacagctttagagactgctcccacactagctctccctgactcatcccaacccttttcattacacatagccaaagtgcagggctgtgcagttggaattcttacacaaggaccgggacggtgtcctgtagccattttgtccaaacaacttgaccttactgttttaggctggccatcatgtttctgtgtggtggttgctgttgccctaatacttttagaggccctcaaaatcacaaactatgctcaactcactctctacagttctcataacttccaaaatctattttcttcctcacatctgacacatatactttctgctccgcagctccttcagctatactcactctttgttgagtctcccacaattaccattgttcctggcccagacttcaatctggcctcccacattattctggataccacagctgacccccataactgtatctctctgatctacctgacattgactccatttccccatatttccttctttcctattcctcaccctgatcacacttggtttatcgatggcagttctaccaggcctaattgccactcaccagcaaaggcaggctatgctatagtatcttccacatctatcattgaggctaccactctgcccccctccactacctctcagcaagctgaactcattgccttcactcaagccctcactcttgcaaagggacaatgcatcaatatttacactgactctaaatatgccttgcatatccacaccaccatgctgttatatgggcagaaagaggtttcttcactacacaatggtcctccatcattaatgcctctttaataaaataggcctcttctcaaggcctatttacttccaaaggaagctggagtcattcactgcaagagccatcaaaaggtgtcaaatcccatcgctcagggctatgcttatgctgataaggtagttaaagaagcagctagtgttccaatttctgtccctcacggccagtttttctccttctcatcggtcactcccacctactcccccactgaatctttcagctatcaatctcttcccacacaaggcaaatggttcttagaccaaggaaaatatctccttccagcctcacaggtccattctattctgtcatcatttcataaccttttccatgtaggttacaagccattagcccgcctcttagaacctctcatttcctttccatcatggaaatctatccttaaggaaatcacttctcagtgttctatctgctattctactacccctcagggattgttcaggctccctcacttccctacacatcaagctcggggattagcccatgtccaggactggaaaattgactttactcacataccccgagtcaggaaactaaaatacctcttggtctgggtagacacttgaactggatgggtagaggtctttcccacagggtctgagaaggccactgcagtcatttcttcccttctgtcagatgtaattcctcagtttggcctttccacctttatacattccgataatggaccggccattctagtcaaatcaccccagcagtttctcaggctcttggtattcagtggaaccttcataccctttaccatcctcagtcttcaggaaaggtagaacggactaatggtcttttaaagacacacttcaccaagctcagcctccaacttaaaaaggactggacagtacttcttttttttttttttttaattatactttaagttcaagggtacatgtgcacaacatgcaggtttgttacatatgtatacatgtgccatgttggtgtgctgcacccattaactcattgtttacattaggtatatctcctaatgctatccctccccactcccccaccccacgacaggccccggtgtgtgatgttccccttcttgagtccaagtgttctcattgttcaattccaaactatgagtgagaacatgtggtgtttggttttttgtccctgcgatagtttactgagaatgatgatttccagcttcatccatgtccctacaaaggacatgaaatcatccttttttatggcgcatagtattccatggtgtatatgtgccacattttcttaatccagtctatcattgatggacattcgggttggttccacatctttgctattgtgaatagtgccgcgataaacatacatgtgcatgtgtcttcatggcagcatgatttataatcctttgggtatatacccagtaatgggatggctgggtcaaatggtatttctagttctggatccctgaggaatcgccacactgtcttccacaatggttgaaccagtttacagtcccaccaacagtttaaaagtgttcctatttctccacatcctctccagcacctgttgtttcctgactttttaatgatcgccattctaactggtgtgagatggtatctcattgtggttttgatctgcatttctctgatggccattttttcatgtgtcttttggctgcataaatgtcttcttttgagaagtgtctgttcatatgctttgcccactttttgatagggttgtttttttcttgtaaatttgtttgagttcattgtagattctagatattagccctttgtcagatgagtagattgcaaaaattttctcccactctgtaggttgcctgttcactctgatggtagtttcttttgctgtgcagaagctctttagtttaattagatcccatttgtcaattttggcttttgttgccattgcttttggtgttttagacatgaggactggacagtacttctacctcttgcccttctcagaatcagaacgtgtcctcgagatgctacagagtacagtccattgaacttttacatggacgcactttcttgctcagccccaacctcatcccagacaccagtcctctaggtgactatcttccagtcctccagcaggctagacaggaaattcgccaggctgcttatcttctcttgcctactccagattaccagctatatgaagacaccctagctggacgatcagttcttgttaagaatctgacccctcaaactctacaaccttgatggactggaccctacttagtcatctatagtaccccaactgccgtccacctgcaggatcctccctactgggttcaccattccagaataaggctgtgtccgttggacagccagcctaatccctcctcttcctcctggaagtcgcaagtactctctcctacttcgcttaaactcacttgcatttctgaagaacagtaataaccctcatgagcctaatacatcccttcattctattaagactattcatccttaccctactttttgcaacagggctttatgcaatcaccctcactatttggactgcaccccaaaaacttgtcatccctactgtcttctgactagtcatactcctattcaccattctcaactacttgtaaatgccctgcccttgtttacactggtggtttacccttttccttcaaaccatcataactgatatctcctggttttacctcaaactgccacttttaagtctctcttaaggtgaatagatgatctttgctgacagggcacactccaatactttcaccctgatgaagttctgttctttacttttatactcactcttattctcattcccattcttatgccaccctctacctctccccagctatctccaccacactatcaatctcactctctgctagccatttctaatccctccttagcgaacaattgctggctttgcatttccctttcttcctgtgcttacacagctgtccccgccttacatacagactgggcaacatctcctgtctccctacacctccgaacttcctttaacagccctcacctttaccctcctgaagaacttctttactttctagacaggtccagcaagacctccccagacatgtgacatcagcaagctgccgccctcctccgcacttacttaaaaaaacctttctccttatatcaactctactccccacatattcggacccctcacaacacaaactactattgctgtggctgctcctttttgtatctctcagcaaagacccactggaattccctttcaccttcgtgatgttccttcactcttcatctccaaagcccaactacacacaccactgaaacaattggagcctcccagctccgtattacagataagccctctatcaatacgggcaaacttaaaaacattagcagtaattattgcttacgaaggcacttaccctgtatttcactccaaccttggctaccttccccttgctcgtcagactctcctcccaggccctcttcttgtttacttatacccagccccataaataacagtgaaaagttgtttgtagatactcatcgttttctcacacaccatgaaaatcgaacctccccctctaagcagttaccctatcagtccccattaaaacctctgacagctgccgccctagctggatccctaggagtctgggtagaagacacttctttcagcactccttctcatctttttactttgcatttccagttttgctttatacaaggtctcttcttcctctgtgtatcctctacctacatgtgtctacctgctaattggacaggcacatgcacattaattttccttactcccaaaattcaatttgcaaatgggacggaagagcttcctgttccccacatgacactgacacgacaaaaaagagttattccactaattcccttgcttgtcagtttaggactttctgcgtccactaatgttcttggtactggaatagcaggcatttcaacctctgtcatgacctttcgtagcctctctaatgacttctctgctagcatcacagacgtatcacaaattttatcagtccttcaggcccaagtgactctctagctgaggttgtcctccaaaaccgccgaggccttgacttactcactgctgaaacatgaggactctgtatattttttaaagaagagtgttgtttttacctaaatcaatctggcctggtgtaagacaacataaaaaaactcaaggatagagcaccaaaactctccaaccaagcaagtaattatgctgaacccccttgggcaccctctaattggatgtcctgggtcctcccaattcttaattctttaatacctgttcttctcctcttattcagaccttgtatcttccgtttagtttctcaattcatacaaaactgcatccaggccatcaccagtcattctatatgacaaatactccttctaacaaccccacaatattgccccttaccacaaaatcctccttcaacttgacctctgctactctaggttcccacgctgcccctaatcctgcttgaagcagccctgagaaacatcgcccattatctctccataccacccccaaaaattttcgccgtcccaacactttaccactattttgttttatttttcttattaatataagaagaaaggaatgtcaggcctctgagcccaagcctgcaggtatacatccagatggcctgaagtaattgaagaatcacaaaagaagtgaaaatggccatttcctgccttaactgaagacattaccttgtgaaattccttctcctggctcagaagttcccccactgagcaccttgtgaccccccacccctgcccgccagagaacaaccccctttgactgtaattttccactacctacccaaatcctataaaacggccctacccctttctcccttcgctgactctctttttggactcagcccgcctgcacccaggtgattaaaaagctttattgctcacacaaagcctgtttggtagtctcttcacacagacacgtgtga

SEQ ID NO: 288 - DNA, 6807 bp, Homo sapiens
cccctttgggtcctctccccttgtacgggagctctgttttcactctatttcactctattaaatcttgcaactgcactcttatgatccatgtttgttacggcttgagctgagctttcgctcgctgtccaccactgctgttttgccaccatggcagacccaccactgacctccatccctccgcatccagcagggtgtccgctgtgctcctgatccagtgaggcgcccgttgccactcccgattgggctaagggcttgccaatgttcctgcatggctaagtgcctgggttcgtcctaatcgagctgaacactagtcactgggttccatggttctcttccatgacccacaacttctaatagagctataacaagcactgcatggcccaagattccattccttggaatccgtgaggccaagaaccccaggtcagagaacacgaggcttgccaccatcttggaagtggcccaccgccattttggaagtggccaaccaccatcttgggagctctgggagcaaggacccctggtaacattttggcgaccacgaagggacatcccaagtggtgagtaatattggaccactttcgcttgctattctgtcctatccttccttagaactggaggaaaacaccgggcacttgtcggccagttaaaaatgataagcatggccgccggactaaagactcggtgtgaggctatctggggaagggcttcctaacaacccccaacccttctaccggggacattggtctgcctggagccagcttccacctttgattttcttggggaagctgagggccagctagaggcagaaagctgttgtcctgaactccctgcagtagccggttaagatcgtggcgcagccagaagtctctactcaacagtcgcccatgcgtgcgcccctacctttcctcctgacccatacctcctgggtcctgaccacgactttcttgaaagtgtagccccaaaattctccttacctctgaatctgcttcctctgatccctgcctcctaggtactaatggttcagactttcatttcctctagcaagttgtatctgcaaagggatctaaggaagctctacactgcgtccttaggcacataggctgtaacccagggagtcttacccctggtatccctcccgatttaggtatacggctctcgacatgggcagttacgtgggatccattccccaccacccttgccagggccccaagtttgtaatggctaagaaagacagagagacagagatggagagagagacaaagagggagtcaaggagaaaaagaaaggaaaagatagaaatagttaaaaaaaaaaaaagtgtgcgtattcctttaaaagccagggtaaatttaaaacttgtaattgataattgccactttgttgtcagtgtaaataagggtgtagcaaatcctgaacccagtaacccatggatgggccaaatgcattcagtctgtagtgacaactgctttactaaaagtagaaaagtaacttttagaggaaacctggttgtgagcacacctcaccagttcagagttattccaagtcaaaaaaaaaaaagcaaaaaggtagcttactaactcaaaaaccttaaagtattgggctattctgttagaaaagggtaatgtaactccaaccactgataattcccttaacccagcagatttcctaaccggggatttaagacttaattaccatacaaaggtccaaccagagctaggaggaactcccttcaggacaggaggttagatggttcctcctaggtgattgaggaaaaaaccacaatgggtaatcagtaattgataggagactcttgtggaagcagagttagaaaatttgcctaataactggtctcctcaaatgtgcgagctgtttgcactcagccaagccttaaagtacttacagaatcaaaaagactatctcaatcctgactcaaaaagttacctacaccctctctgaaatgaatttgcataagaactgcttttataggaatgcatcttgatggggtggctgggttgttatgaaatactcaggaacccagcccagctctaggactcacccctgagtgcaaaggcaatgttgggcacgctggtaaaggaccactagaatccagagggtgcccagacacctttcttagtggtcaaaagaggcaggaaaacaggtgcaggactgctacattggccagcataactaatccgataagcagaggtccgtgggtggttacgcaccctggaaaggaactcacctctgagcacaaaggcaatgttgggcatgccggtaaaggaccactagaatccagcagcccggacccctttctctgtggtcaagagaggcgggaaaacaggtgcaggactgctacatcggtgagtgtaactaatccgataagcagaggtccatgggtggttacacaccctggaaaagaataagcattaggaccataggggacactctaggactaatgctcatgggaaaatgactaggggtgctggcatccctattttcttttttcagaggggaaacattccccccaaggcaaaaaaacccctaacgtattctggagaactgggaccaatttgaccctcagatgctaagaaagaaatgacatattcttctgcagtactacctggccatgatatcctcttcaagggggagaaacctggcctcctggggaagtataaattataacagcatcttacagctagaccttttttgtaaaaaaaaaaaaaaaaaaaaaaaaaaaaggcaaatggagtgaagcaccatatgtacaaactttttttcattaagagacaactcgtaattatgtaaaacgtgtgatttatgccctacagaaagccctcagagtctacctccctaccccagcccccatgaccccaactaataagaaccccccttcaacgcagtgtagaccctcattgggacacagaatcagaacatggagattggtgctgcagacatttgctaatttgcgtactagaaggactaaggaaaactaggaagaagactatgaattattcaatgatgtccactttaacacaagtaaaggaagaaaatcctactgcctttccggagagactaaggggggtattgaggaagcatacctctctgtcacctgactctgttgaaggccaactaatcttaaaggataagtttatcactcagtcaactgcagacattagaaaaaaacttcaaaagtccaccttaggcctggagcaaaacttagaaaccctattgaacttggcaaccttggtttttttaatagacacgaggaggagcaggtggaacgggacaaatgggattaaaaaaaaggccactgctttagtcatggccctcaggcaagcagactttggaggctctggaaaagggaaaagctgggcaaattgaatgcctaatagggcttgcttccagtgtggtctacaaggatactttaaaaaagattgtccaagtagaagtaagctgccccctagtccatgccccttatgtcaagagaatcactggaaggcccactgccccagggaatgaaggtcctctgagtcagaagccactaaccagatgatccagcagcaggactgagggtgcccgaggcaagcgccagcccatgccatcaccctcacagagccccgggtatgcttgaccatagaggctaactgtctcctggacactggtgcggccttctcagtcttactctcctgttctggacaactgtcctccagatctgtcactatccaaggggtcctagaacagccagtcacgagatacttctcccagccactaagctgtgactggggagctttactcttttcacatgcttttctaattatgcctgaaagccccactcccttgttagggagagacattctagcaaaagcaggggccattatacacctgaacataggagaaggaacacctgtttgttgtcccctgcttgaggaaggaattaatcctaaagtctaggcaacagaaggacaatatagacaagcaaaaaatacccgtcctgttcaagttaaagaattccacctcctttccctaccaaaggcagtagcccctcagatccgaggcacaacaaggactccaaaagattgttaaggacgtaaaagcccaaggcctagtaaaagcatgcaatagcccctgcaatactccaattttattattacagagacccaacagacagtggaggttagtgcaagatctcaggattatcaatgaggctgttgttcctctatacctagctgtacctaacccttatactctgctttcccaaataccagaggcagcaaagtggtttacagtcctagaccttaagggtgcttttttctgtatccctgtacatcctgactctcacttcttgtttgcctttgaagatcctttgaacccaacatctcaagtcacctggactgttttaccccaagggttcaaggatagcccccatctatttggccaggcattagcccaagacttgagccagttctcatacctggacaatcttgtccttcagtatggggatgatttaattttggccacccgttcagaaaccttgtgccatcaagccacccaagcactcttaaatttcctcgctacctgtggttacaaggtttccaaatgaaaggctcagctctgctcacagcaggttaaatacttagggctaaaattatccaaaggcaccagggccctcagtgaggaatgcatccagccaatactggcttattctcatcccaaaaccctaaagcaactaagagaattccttggcataacaggcttctgccaaatatggattcccaggtacggtgaaatagccaggccattatacacactaattaaggaaactcaaaaagcgaatacccatttagtaagacagacacctgaagcagaagcagctttccaggccttaaagaaggccctaacccaaaccccagtgttaagcttgccaacggggcaagacttttctttatatgtcacagaaaaaaaacaggaatagctctaggagttcttacacaagtccaagggacgagcttgcaacctgtggcatacctgagtaaggaaatagatgtagtgacaaagggttggcctcattgtttacaggtagttgctgcagcagcagtcttagtatctgaagcagttaaaataatacagggaagaaatcttactgtgtggacatctcatgatgtgaacggcatgctcactactaaaggagacttgtggctgtcagacaaccatttacttaaatatcaggctctattacttgaagggccagtgtggcaactgcacacttgtgcaactcttaacccagccacatttctttcagacaatgaagaaaagatagaacataactgtcaacaagtaattactcaaacctgtgccactagaggggaccttttagaggttcccttgactgatcctgacctcaacttgtatactgatggaagttcctttgtagaaaaaggacttcaaaaagtggggtatgcagtggtcagtgataatggaatacttaaggtaatcccctcactccaggaactagtgctcagctggcagaactaatagccctaatttgggcactagaattaggagaaggaaaaagggtaaatatatataaagactctaagtatgcttacctagtcctccatgcccatgcagcaatatggagagaaagggaattcctaacttctgagggaatacctatcaaacatcaggaagccattaggagattattattggctgtacagaaacctaaagaggtgatagtcttacactgccagggtcatcaaaaaggaaagaaaggaaaatagaagggaaccgccaagcggatattgaagtcaaaaaagccacaaggcaggacccttcattagaaatgcttatagaagggcccctagtatagggtaatcccctccgggaaaccaaaccccagtactcagcaggaaaaatagaatagggaacctcacgagaacaaacttccctcccctccagatggctagccaccaaagaaggaaaaatacttttgcttgcagctaactaatagaaattacttaaaacccttcaccaaaccttccattaggcattgatagcacccatcagatggccaaattattatttactggtccaggccttttcaaaactatcaagcagatagatagtcagggcctgtgaagtgtgccaaagaaataatcccctatactgcaggccatacatttcaatccctgtatctttaacctccttgttaagtttgtctcttccagaatcaaaatggtaaaactacaaatgggtcttcaaatggagccccagatgcagtccatgactaagatccaccacagacccctggactggcctgctagcccatgatccgatgttaatgacatcaaaggcacccctcccaaggaaatctcaactgcccaacccctactatgccccaattcagcaggaagcagttagagcagtcattggccaacctccccaacagcacttggatcttcctgttgagaggggggactgagagataggactagctggatttcctaggccaactaagaatccctaagcctagctgggaaggtgaccgcatccacctttaaacacggggctcgcaacttagctcacacccaaccaatcagagagctcactaaaatgctaattaggcaaaaacaggaggtaaataatagccaatcatctattgcctgagagcacagcgggagggacaaggaacgggatataaaaccaggcattcgagctggcaatggcaaccccctttgggtccccttcccttgtatgggagctctgttttcactctatttcactctattaaatcttgcaactgca

SEQ ID NO: 289 - DNA, 5537 bp, Homo sapiens
gtcaggcctctaagcccaagctaagccatcataaaccctgtgacctgcacatacacatccagatggccggttcctgccttaactgatgacattccaccacaaaagaagtgaaaatggcctgttcctgccttaactaatgacactatcttgtgaaattctttctcctggctcttcctggctcaaaagctcccctaatgagcaccttgcgacccctactcctccaaccagagaacaacccccctttttcctttacctacccaaatcctataaaacggccccactcctatctccctttgctgactcccttttcagactcccttttcacctgcacccaggtgaaataaacagccttgttgctcacacaaagcctgtttggtggtctcttgacatggacgcgcatgaaatttggtgctgtgactcagatggggggacctcccttgggagatcaatcccttgtcctcctgctctttgctccatgagaaagatccacctatgtcctcaggtcctcagaccgaccagcccaagtaacatctcaccaatttcaaatctggtaagtagcctctttttactcttttctccaacctccctcactatccctcaacctttttctcctttcaatcttggcaccacacttcagtctctcccttctcttaatttcaattcctttcattttctggtagaggcaaaggagacatgttttatcaatggacccaaaactccggcgccggtcacggactagggaaggcagccttcccttggtgtttaatcactgcagggacacctctctgattattcacccaggtttcagaggtgtcagaccacacagggacacctgccttggtccttcacccttagcggcaagtcccgcttttctgggggagaggcaggaaccccgacctcttatctctgcaccctgatcccttatttccataccgtgacctcttatctccatgccctgaccccttctctgcttttttggagggcaagaactccccaccccttctccgtgtctctactcttttttctctgggcttgcctccttcactatgggcaaccttccaccttccattcctccctcttctcccttagcctgtgttcttaagaacttaaaacctcttcagctctcacctgacctaaactctaagcatcttattttcttctgcaatgccacttgaccccaatacaaactcgacagtagttccaaatagccagaaaacggcactttcaatttttccatcctaccagatctaaataattcttgtcgtgaaatgggcaaatggtctgaggtgcctgacatccaggtgttcttttacacatctgtctctccctagtctctgttcccaatgcacctcatcccaaatcttccttctttccctcccacctgtcccctcagtcccaaccccaagcatcactgagtctttctaatcttccttttctacagacccatctaacctctcccctcctcgccaggctgagctaggtcccaattcttcctcagcctccactcctccaccctataatccttttatcacctgccctcctcacacccggtctggcttactgtttcgttccatgactagccctcccccacctgtccagcaatatcctcttaaaaaggtggatggagctaaaggcctagtcaaggttaatgctcctttttctttatcccaaatcagatagcgtttaggctctttttcatcaaatataaaaacctagcccagttcatggctcgtttggcagcaacactgagatgttttacagccctagactctaaaaggtcaaaaaaccgtcttattctcaatatatattttattacccaatctgctcccgacattaaataaaactccaaaaattaaattccggccctcaaatcccacaataggacttaattaacctcaccttcaaggtgtacaattccttgcctccgctgtgagacaaaccccagccacatctccagcacacaagaacttccaaatgcctcaatcacagtggccaagtgttcctccaggcccgcctcccccaggagcttgctacaagtgccagaaatctggccaccaggccaaggaatgcctgcagcctgggattcctcctaagctgtgtcccaactgtgcaggaccccactgaaaatcagactgttcaatttacctggcagccactcccagagcccctgaactctggcccaaggctctctgactacttcccagatcttctcggcttagcagctgaagactgatgctgcctgatcgcctcagaagcccctagacgaccatcacagatgccgagcttcgggtaactctcacagtggagggtaagtccgtccccttcttaatcaatacggaggctacccactccacattaccttcttttcaagggcccgtttcccttgcctccataactgttgtgggtattgacagccaggcttctaaacctcttaaaactccccaactctggtgccaacttagaagacactctttttgcactcttttttaattatccccacctgcccagttcccttattaggccgagacactttaactaaattatctgcttccctgactactcctgggctacagccacacctcattgccaccttttcccccagttcaaagcctccttcacatcctccccttgtatctccccaccttaacccacaagtataagacacctctactccctccttagtgactcatcatgcaccccttaccatcccattaaaacctaatcactcttaccctgctcaatgccaatatcccatcccacagcacactttaaaaggattagagcctgttatcactcgcctgttacagcatggccttttaaagcctataaactccccttacaatttccccattttacctgtcctaaaaccagacaagacctacaggttagttcaggatctgcgccttatcaaccaaattgttttgcctatccaccctgtggtgccaaacccatatactctcctatcctcaatacctccctctacaacccattattctgttctggatctcaaacatgctttctttactattcctttgcactcttcatcccagcctctcttcgctttcacttggactgaccctgacacccattaggctcagcaaattacctgagctgtactgccgcaaggcttcacagacagccccctttacttcagtaaagcccaagtttcatcctcatctgttacctatctcagcataattctcataaaaacacacgtgctctccctgctgatcgtgtccagctaatctcccaaacctcaatcccttacaaaacaacaactcttttctttcctaggcacggttagtgcagtcagaattcttacacaagagctgggaccgcaccctgtagcctttctgtccaaacaacttgaccttactgttttaggctggccatcttgtctccgtgcagcagctcctgctgccctagtacttttagaggcccttaaaatcacaaactatgctcaactcactctctacagctctcataatttccaaaatctattttcttcctcacacctgacgcatatactgtctgctccccggctccttcagctgtactcactctttgttgagtctcccacaattacaattgttcctggcccggacttcaatccggcctcccacattattccagataccacacctgaccctcatgactgcatctctctgatccacctgacgttcaccccatttccttcttccctgtttctcacgcagatcacacttggtttattgatggcagttccaccaggcctaatcgccacacaccagcaaaggcaggctatgctatagtacaagccactagcccgcctcttagaacctctcatttcctttccatcgtggaaatatatcctcaaggaaataacttctcagtgttccatctgctattctaccactcctcagggattattcaggccccctcccttccctacacatcaagctcagggatttgtccccaccaaggactggcaaatttgctattctactacttctcagggattattcaggcccctcccttccctacacatcaagctcagggatttgcccccgcccaggactggcaaattagctttactcaacatgccctgagttaggaaactaaaatacctcttggtctaggtagacactttcactggataggtagaggactttcccacagtgtctaagaaggccaccatggtcatttcttcccttctgtcagacataattcctcggtttggccttcccacctctatacagtccgatagcagactggcctttattagtcaaatcagccaagcattttttcaggctcttagtattcagtgaaacctttatatcccttacagtcctcagtcttcaggaaagaacagaataatggtcttttaaaaacacacctcaccaagcttagccaccaacttaaaaaggactggacaatacttttaccactttcccttctcagaattcaggcctgtcctcagaatgctaaaaggtacagcccatttgagctcctgtatagatgctcctttttattaggccccagtctcattccagacactagaccaacttggactgtgccccagaaaacttgccatctctactatcttctgtctagtcatactcatattcaccgttctcaactactcatacctgccctgctcttgtttacactgccagtttacactgtttctccaagccatcacagctgatatctcttggtgctatccccaaatcgccactcttaactcttgaagtaaataaataatctttgctggcaaggctatactgaaccttcttaggcactctttacttaaatgtcctaggtcctcccaattcttagtcctttaatacctgtttttctccttctcttatcccatttagtttttcaattcatataaaactgtatccaggccatcaccaataattctaaatgacaaatgtttcttctaacaaccccataataccaccccttaccacaaaatcttccttcagtttaatctctcccactctatgttcccacgccacccctaatcccactggaagcagccctgagaaacatcgcccattaactctccataccacccccaaaattttcaccatcccaacactttaccactatttcattttatttttcttattaatataagaagacaggaatgtcaggcctctgagcccaagctaagccatcatatcccctgtgacctgcacatacacatccagatggccagttcctgccttaactgatgacattccaccacaaaagaagtgaaaatggcctgttcctgccttaactgatgacattatcttgtgaaattccttctcctggctcatcctggctcaaaagctcccctactgagaaccttgtgaccccccactcctccaaccagagaacaacccccctttttcctttacctatccaaatcctataaaacggccccaccccatctcccttccctgactctattttcagactcagcccacctgcacccaggtgaaataaacagcctgttgctcacacaaagcctgtttggtggtctcttcacatggaagcgcatgaaa

SEQ ID NO: 290 - DNA, 1177 bp, Homo sapiens
aaaaagacaggaattgctcactcagggagctcggctcttgagacaggagtcttgctgatgcccctggccgaataaaccccttccttctttaactcagtgtctgaggagttttctgcgcctcgtcctgctacatttcttggttccctgatggggaagcgaggtgaatggcggatggtcgaggcagctccttaggcggcttaagcctgccgtgtggaacatccctgcgggcgactctaactagcccgggcgacgcggatcctgagagtgctccctggtaggcatttgccccaggaggacgcttcgccagagcagtgtgtggcaggcccctgtggaggatcaacacagtggctgaacaccaggaaggaacgggcacttagagtctggacatctaaaacttggtaagactagtctttgaaacttgcccactccaggccaggtgtggtgcctcaggcctgtaatcccagcactttgggaggccaaggcgggcggatgacgaggtcaggagatcgagaccatcctggctaacacggtgaaaccccttctctactaaaaatacaaaaaaattagctgggcgtggtggtgggtgcctgtagtccccaccagagcgagactccgtctcaaaaaaaaaaaaaaaagaaacttgcccactgcatttaagtggaagcgtggcctgatcacccatggtgtgcctgtaccggcactttagtttttgtttttgacttgacttagattgcttaatactctggttttggttttgacctaacttagatttctagatactctgattttagttttgattttagtttggtgcaaactgcgaaagtgtgtgtgtgccctttttacctgttctttgttttgtggtgtgcgtgtggtgtgagtgtggtgttttgtgtcgaagaagcataggtcaggcacaaataagcccaccctgctaggaactatgttgaaaaatttcaaaaaagaatttaaaggagactatagagtactatgacacgaggaaaacttaaaactttgtgtaagatagactggccagcattagaggtaggttggccattagaaaaaagcctggacaggtcccttgtttcaaaggtatggcacaaagtaacctgtaagccagggaacccagaccagttcccgtacatagacacttggttacagctagttttagaccccccgc

SEQ ID NO: 291 - DNA, 491 bp, Homo sapiens
ttagagtaagtagttaggcagacatgagcagggcagaagaggccctgcagccatgctcccaccaaccaggaatgtcaggtgaccatcaggtgatggtcaggtagttgttaaactgtctctctaaaataataatgggttgcagccagccagggaaaggcactcttccagcaggtagaaaacacctgaaacgtgatcagtagcttccagataagatctcaggagttaggtgaatgggcttaagcatgagcactagaggcaaaatggtggagtttaataggtctacgaccttcctccaggaacgcttgactagtcaaggaaaaatgcctcaaatgaggacatgcacaacttcagtaaacacactgcacgtgcgcccctcccaagtgctgctgggccactgagcatgcagacagcccaccccaaaggaagaatcaagagaggagagatgcaaaccccggaagcaagccaaagtataaaaaccccaaatcaagggt

SEQ ID NO: 292 - DNA, 144 bp, Homo sapiens
cttttctgggaaaataagaccaagggagctaaccaaagccaagccccatgcacccaagtcttaccaggcataactacagccccagataggtgtgtcagcaggcttaggatttttgagctgtcctttacccccttatttcttttt

SEQ ID NO: 293 - DNA, 5702 bp, Homo sapiens
gtcaggcctctgagcccaagccaagccattgcaacccctgtgacttgcacctatactcccagatggcctaaagtaactgaagaatcacaaaagaagtgaatatgccctgccccaccttaactgatgacattccaccacaaaagaagtgtaaatggccagtccttgccttaagtgatgacattaccttgtgaaagtccttttcctggctcatcctggcgccaaaagcacccccactgagcaccttgtgacccccactcctgcccgccagagaacaaaccccctttgactgtaattttcgtttacctacccaaatcctataaaacggccccacccttatctcccttcactgactctctttacggactcagcctgcctgcacccaggtgaaataagcagatgtgtcgctcacacaaagcctgtttggtggtctcttcacacagacgcgcatgaattttggtgccatgactcggatcgggggacctcccttgggagatcaatcccctgtcctcctgttctttgctccgtgagaaagatccacctatgacctcaggtcctcagactgaccagcccaaggaacatctcaccaattttaaatcagttaagcggcctcttctgactctcttctccaatctctctcactgtccctcaaccactttctcctttccactcttcaatctctcccatctcttaatttcaattccttccattttctgggagagacaaaggagatacattttatctgtggacccaaaactctggtgccggtcacagactggaaaggcagccttcccttggtgtttaatcattgcagggacgcctctctgattattcaacccacgtttcaaaggtgtcataccacgcagggacgcctgccttggtccttcacccttagcggcaagtcctgcttttctggggaaggggcaagtaccccaaccccttctctccttgtctctaccccttctcagcttttccgggcacagggcaagtactccaaccccttctccttcactcttagcggcaagtcccgcttttctagaggagaggcaagtaccccaacctcgtatctctgtgccccaatcacttatttccacgtcccgacctcttatctctgtgccccaaccccttttcccacttttctggaaggtaagaacccccaaaccccttccctccgtttctctactctctcttttctctaggcttccttccttcactatgggcaaccttccaccctccattcctccttctactcccttggcctgtgttctcaaaaacttaaaaccaattcaactcacacctgacctaaaacctaaatgccttattttcttctgcaatgccacttgaccccaatacaaactccacagtagttccaaatagccagaaaatggcactttgaatttttccatcctgcaagatctaaataattcttgtcataaaataggcaaacggtctgaggtgcctgacgtccaggcattcttttacacatcagtcccttcctagtctctgtgcccagtgcaactcgtcccaaatcttccttctttccctcctgcctgtcccctcagtaccaaccccaagcctcgctgagtctttctaatcttccttttctacagacccatctgacctctcccttcctccccaggctgctcctcgccaggccgagctaggtcccaattcttcctcagcctccgctcctccaccctataatctttttatcacctcccctcctcacacctggtccggcttacagtttccttccatgactagccctccccctcctgcccaacaatttactcttaaaaaggtggctggagctaaaggcatagtcaaggttaatgctcctttttctttatcccaaatcagatagcgtttaggctctttttcatcaaatataaaaatccagcccagttcatgacttgtttgccagcaaccgagacactttacagccctagaccctaaaaggtcaaaaggccatcttattctcaatatacattttattacccaatctgctcccaacattaaataaaactccaacaattaaattccggccctcaaaccccacaacaggatttaattaacctcgccttcaaggtgtacaataatagaaaaaagttgcaattccttgcctccactgtgagacaaaccccagccacatctccagcacacaagaacttccaaacgcctgaaccgcagcggccaggcgttcctccagaacctcctccccaaggagcttgctacacttgccggaaatctggccaccgggccaaggaatgcccgcagcccggaattcctcctaagccgtgtcccatctgtgtaggaccccactgaaaatcggactgttcaactcacctgggagccactctcagagcccctggaactctggcgcaaggctgtctgactccttcccagatcttctcggcttagcggctgaaaactaacaccgcccgatcgcctcggaagccccctagaccatcacggacgccaagcttcaggtaactctcacagtggaaggtaagcccgtccccttcttaatcaatatggaggcacccactccacattaccttcttttcaagggcctgtttcccttgcctccataactgttgtgggtattgacggccaggcttctaaacctcttacaactccccaactctggtgccaacttagacaatactcttttaagcactcctttttagttatccccacctgcccagttcccttattaggctgagacactttaactaaattatctgcttccctgactattcctggactacagctgtatctcattgcctcccttcttcccaatccaaagcctcctttgcgtcctcctcttgtatccccccaccttaacccacaagtataagatacctctactccctccttggcgaccgatcatgcaccccttaccatctcattaaaacctaatcacccttaccccactcaatgccaatatcccatccctcagcacgctttaaaaagattaaagcctgttatcactcgcctgctacagcatggcctttcaaagcctataaactctccttacaattcccccattttacctgtcctaaaaccagacgagccttacaagttagctcaggatctgcgccttatcaacaaaattgttttgcctatccaccccgtggtgccaaacccatatactctcctatcctcaatacctgcctctactatccattattctgttctatatctcaaacatgctttctttactattcctttgccccttaatcccagcctctcttcgctttcacttggactgaccctgacacccatcaagctccacaaattacctaggctgtactgctgcaaagcttcacagacagcccccattacttcaatcaagcccaaatttcttcctcatctgttacctatctcggcataattctcataaaaacacacgtgctctccctgccaatcttgtccgaccgatctctcaaacccaaacaccttctataaaacaacaactcctttccttcctaggcatggttagtgcggtcagaattcttacacaagagccaggaccgcaccctgtagcctttctgtccaaacaacttgaccttactgttttagcctagccctcatgtctgcatgcagcggctgccgctgctttaatacttttagaggccctcaaaatcacaaactatgctcaactcactctctacagttctcataacttccaaaatctattttcttcctcatacctgattcatatactttctgcttcccggctccttcagctatactcactctttattgagtctcccacaattaccgttgttcctggcccagacttcagcctcccacattattcctgataccacacttgacccccataactgtatctctctgatccacctgacattcaccccatttccccaaatttccttctttcctgttcctcaccctgatcacgcttgatttattgatggcggttccaccaggcctaatcaccacacaccagcaaaggcaggttatgctatagtacaagccactagcccgcctctcagaacctccatttcctttccatcgtggaaatctatcctcaaggaaataacttctcagtgttccatctgctattctactactcctcagggattattcaggccccctcccttccctacacatcaagctcgaggatttgccccacccaggactggcaaattagctttactcaacatgccctgagtcagataactgaaatacctcttagtctaggtagacactttcactggataggtagaggcctttcctacagggtctgagaaggccaccgcagtcatttcttcccttctgtcagacataattcctcagtttagccttcccacctcaatacagtctgataatagaccagcctttattagtcaaatcagccaagcagtttttcaggctcttagtattcagtgaaacctttatatcccttaaggtcctccgtcttcaagaaaagtagaacggactaaaggtcttttaaaaacacacctcaccaagctcagccaccaacttaaaaaggactggacaatacttttaccactttcgtttctcagaattcaggcctgtcctcggaatgctacagggtacagcccatttaagctcctgtacagatgctcctttttattaggccccagtctcatttgacaccagaccaacttagactgtgcccccaaaaaacttgtcatccctactatcttctgtctagtcatactcctattcaccgttctcaactactcatacatgccctgctcttgtttacactgccggtttacactgtttctccaagccatcacagctgatatctcctggtgctatccccaaactgccactcttaactcttgaagtaaataaataatctttgctggcaggactatgctgaatctccttaggcactctctcatcagatgtcctgagtcatcccaattcttaaaccttttatgcctgtttttctccttctgttattccatttagtttttcaattcgcacaaaaccgtatccaggccatcaccaatcattctatacgacaaatgtttcttcttacatccccacaatatcaccccttaccacaagacctcccttcagcttaatctctcccactctaggttcccacgccgcccctaatcccgcttgaagcagccctgagaaacatcgcccattctctctccataccaccccctaaaaattttcaccaccccaacactttaacattattttgttttatttttcttattaatataagaaggcgggaatgtcaggcctctgagcccaagccaagccattgcaacccctgtgacttgcacatatacgcccagatggcctgaagtaactgaagaatcacaaaagaagtgaatatgccctgccccaccttaactgatgatattccaccacaaaagaagtgtaaatggccggtccttgccttaagtgatgacattaccttgtgaaagtccttttcctggctcatcctggctcaaaaagcacccccactgagcaacttgcaacccccactcctgcccgccagagaacaagccccctttgactgtaattttcctttacctacccaaatcctgtaaaacggccccacccttatctcccttcgctgactctcttttcggactcagcccacctgcccccaggtgaaataaacagccatgttgctcacacaaatcctgtttggtggtctcttcacagggacgcgcatgaaa

SEQ ID NO: 294 - DNA, 5720 bp, Homo sapiens
gtcaggcctctgagcccaagccaagccatcgcatctcctgtgacttgcacatatatgcccagatggcctgaagtaactgaagaatcacaaaagaagtgaaaaggccctgccctgccttaactgatgacataccaccattgtgatttgttcctgccccaccttaactgagtgattaaccctgtgaatttccttctcctggtacagaagctcccccactgagcaccttgtgaccccgcccctgcccaccagagaacaaccccctttgactgtaattttccattaccttcccaaattctataaaatggcccacccctatctcccttcgctgactctcttttcggactcagctctcctgcaaccaggtgaaataaacagccatgttgctcacacaaaccctgtttggtggtctcttcacacagacgcgcatgaaatttggtgccgtgactcggatggggggacctcccttgggagatcaatccccccgtcctcctgctctctgctccgtgagaaagatccacctatgacctcaggtcctcagaccgaccagcccaagaaacatctcaccaatttcaaatccggtaagtggcctctttttactctcttctccaacttccctcactatccctcaacctctttctcctttcaatcttggcgccacacttcaatctctcccttctcttaatttcaattcctttcattttctggtagaaacaaaggagacacattttatccgtggacccaaaactccggcgccggtcacggactgggaaggcagccttcccttggtgtttaatcattgcagggacgcctctgattattcacccacgtttcaaaggtgtcagaccatgcagggacgcctgccttggtccttcacccttagcggcaagtcccgcttttctaggggaggggcaagtaccccaaccccttctctccgtgtctctaccccttctctgattttctggggcaagggcaagaacccctcaaccccttctccttcccctcagtggcaagtcccgcttttctaggggaggtgcaagtaccccaaccccttctctccgtgtctctaccccttctctgcttttctggaggggggggcacgtaccccaaccttgtatctctgcaccctgatcccttatttccatgccccaacctcatatctctgcaccccgaccccttctctgcttttctggagggcaagaaacccccaccccttctccatgtctctactcttttctctgggcttgcctacttcactatgggcaagcttccaccttccattcctccttctcccttagcttgtgttcttaagaacttaaaacctcttcagctctcacctgacctaaaatctaagtatcttattttcttctgcaatgccacttgaccccaatacaaactcgacagtagttccaaatagccagaaaaacggcactttcaatttttgcatcctacaagatctaaataattcttgccgtaaaatgggcaaatggtctgaggtgcctgacgtccaggcattcttttacacatcggtcccttcctagtctctgtgcccagtgcaactcatcccaaatcttccttctttcccctcccgcctgtcccctcagtcccaaccccaagcatcactgagtctttctaatcttccttttctacagacccatctgacctctcccttcctcaccaggccaagctaggtcccgattcttcctcgcctccgcccctccaccctataatctttttatcgcctcccctcctcacacctggtctggcttacagtttcgttccgtgactagccctccaccacctgcccagcaatttactcttaaaaaggttgctggagccaaaggcatagtcaaggttaatgctcctttttctttatcccaaatcagaagtgtttaggctccttttcatcaaatataaaaacccagcccagtttatggctcgttccacagcaaccctgagacgctttacagccctagaccctaaaaggtcaaaaggccatcatattctcaatatacattttattacctaatctgctcccgacattaaataaaactccaaaaactggaatctggccctcaaaccccacaacaggacttcattaatctcaccttcaaggcgtacaataataaaaaaaaagttgcaattccttgcctccactgtgagacaaaccccagccacatctccagcacacaagaacttccaaacgcctgaaccacagcagccaggagttcctccagaacctcctcccacaggagcttgctacaagtgccagaaatctgaccaccaggccaaggaatgcctgcagcccaggattcctcctaagccgtgtccatctgtgcgggaccccactggaaatcggactgttcaactcacctggcaggcactcccagagcccctggaattctggcccaaggctctctgactccttctcggcttagcagctgaagactgacgctgcccgatcacctcgaaagccccatagatcatcacagacgctgagcttcgagtaactctcacagtggaaggtaagtccgtccccttaatcaatatggagcctacccactccacattaccttcttttcaagggcctgtttcccttgcctccgtaactgttgtaggtattgacggccaggcttctaaacctcttaaaactccccaactctggtgccaactgagacaatactcttctaagcactcttttagttatccccacctgctcagttcccttattaggccgagacactttaactaaattatctgcttccctgactagtcctggattacagctacatctcattgctgcccttcttcccaatccaaagcctcctttgcgtcctcctcttgtattcccccaccttaacccacaggaataagatacctctactccctccttggtaactgatcatgcaccccttactatctcattaaaacctaatcacccttaccccgctcaatgccaatatctcatcccacaccatgctttgaaaggattaaagcctgttatcacttgcgtgctacagcatggccttttaaagcctataaactctccttacaattcccccattatacctgtcctaaaaccagacaagccttccaagttagttcgggatctatgccttatcaaccaaattgttttgcctatccaccctatggtgccaaacccatatactctcctatcctcaatacctccctccacaatccattattctgttctggatctcaaacatgttttctttactattcctttgcacccatcatcccagcctctcttcgctttcagctggactgaccctaacacccattaggctcagcaaattacctgggctgtactgccgcaaggcttcacagacagcccccattacttcagtcaagcccaaatttcaccctcatctgttacctatctcagcataattctcataaaaacacaggtgctctccctgctgatcgtgtccaattaatctccccaacctcaatcccttacaaaacaacaactcctttccttcctaggcatggttagtgtggtcagaattcttacacaagagccaggaccgcaccctgtagcctttctgtccaaacaacttgaccttactgttttagcctagccctcatgtctccgtgcagcggctgctgccaccctaatacttttagaggccctaaaaatcataaactatgctcaacttactctctacatttctcataacttccaaaatctattttcttcctcatacctgatgcatatactttctgctccccggctccttcagctgtactcactctttgttaagtcccacaattaccattgttcctggcccagacttcaatctggcctcccacattattcctgataccacacctgacccccatgactgtatgtctctgatccacctgacattcaccacatttccccatatttccttctttcctgttcctcaccctgatcacgcttgatttattgatggcagttccaccaggcctaatcgccacacaccagcaaaggcaggctatgctatagtacaagccactagcccgcctcttagaacctctcatttcctttccattgtagaaatctatcctcaaggaaataatttctcagtgttccatctgctattctatctgctattctactactcctcaaggattattcaggacccctcccttccctacacatcaaacttgaggatttgccccctgcccccgcccccggaactggcaaattagctttactcaacatgccctgagtcacaaaaactaaaatacctcttagtctaagtagacactttcactagataggtagaggcctttcctacagggtctgagaaggccactgcagtcatttcttcccttctgtcagacataatccctcagtttagccttcccacctctatacagtctgataacagaccaacctttattagtcaaatcagccaagcagtttttcaggctcttagtattcagtgaaacctttatatcccttatagtcgtctgtcttcaagaaaagtagaacggactaaaggtctttcaaaaacacacctcaccaagctcagccaccaacttaaaaagaactggacaatacttttaccactttcccttctcagaagtcagacccgtcctcagaatgctacaaggtacagcccatttgggctcctgtatagatgctcctttttattaggccccagtctcattccaaacaccggaccaacttagagtgtgccccaaaaaaaacttgtcatccctactatcttctgtctagtcatactcctattctccgttctcaactactcatacatgccctgctcttgtttacactgccggtttacactgtttctccaagccatcacagctgatatctcctcgtgctatccccaaaccgccactcttaactcttgaagtaaataaataatcttggctggcaggactatgctgaatctccttaggcactctctaatcagatgtcctaggtcctcccaattcttagaccttttatacctgtttttctccttctcttattccatttagtttttcaattcatacaaaaccgtatccaggccatcaccaatcattctaaatgacaaatgtttcttctaacaaccccacaatatcaccccttaccacaaaatcttccttcagcttaatctctcccactctaggttcccacgccgcccctaatcccgcttgaagcagccctgagaaacatcgtccattctctctccatatcacccccccaaaattttcaccaccccaagacttcaacactgttttatttttcttattaatataagaaggcaggattgtcaggcctctgagcccaagccaagccatcgcatctcctgtgacttgcacatatatgcccagatggcctgaagtaactgaagaatcacaaaagaagtgaaaaggccctgccccgccttaactgatgacattccaccattgtgatttgttcctgccccaccttaactgagtgattaaccctgtgaatttccttctcctggctcagaagctcccccactgagcaccttgtgacccccaaccctgcccaccagagaacaaccccctttgactgtaattttccattaccttcccaaatcctaaaaaacggccccacccctatctcccttcgctgactctcttttcagactcagcccgcctgcacccaggtgaaataaacagccatgttgctcacacaaaccctgtttggtggtctcttcacacaaacgcgcatgaaa

SEQ ID NO: 295 - DNA, 906 bp, Homo sapiens
aggaatgtcaggcaaccatcaggtgatgggcaggaaattattaaccatctctctaaaataataactggtcacagccagcaccagggaaaggtagtctcccaataaacaggaatacctgaagcaggtgatcagcagcttccagtaagatctcaggagctgggtgagtgggctcacacatgtgcatgaagaggcaaaatggcggcatttaactggtatatgacctgctagggacgttcggctggtaagggaagaacgcctcaagggagcatgcgtacaactacagtcaacacactgtgcatgctccctcccaagtgctggcaggtcactgagcgtgcggacagcccaccccaccaacccaagggaggaatcaggggataaggaaaacaagacccctgaagtatgccatgtataaaaccccaagtcaaaggtcaaacagaacccctgaatctctcaagtcgcctggttggcccctcttccaagtgtactttacttcttttcatccctgctctaaagctttttaataagctttcacttctgctgtgaaacttgcctcagtctctccttctgccttatgtccctcagtcgaattcttttttttgtctcactctgtcaccaggctggagtgcagtggcaccatctcggctcactgcaacctccacctcccaggttcaagtgattctcctgcctcagcctcccaagtagctgagattacaggtgcctgccaccacgcctggctaattttttgtattttcagtagagatgggtttcaccatgttagccaggatggtctcaatctcctgacctcaggatccgcccacctcggcctcctaaagtgctgggattacagccatgagaattctttcttctgaggaggcaagacctgaggatgctgaggcctgtatggat

SEQ ID NO: 296 - DNA, 4094 bp, Homo sapiens
gtcaggcctctgagcccaagccaagccatcgcatcccctgtgacttgcatgtatacgcccagatggcccaaagtaactgaagaatcacaaaagaagtgaatatgccctgccccaccttaactgatgatattccaccacaaaagaagtgtaaatggccggtccttgccttaagtgatgacattaccttgtgaaagtccttttcctggctcatcctggctcaaaaagctcccccactgagtaccttgcgacccccactcctgcccgccaaagaacaaaccccctttgactgtaattttcctttacctacccaaatcctataaaacggccccacccctatctccctttgctgactctctttggactcagcccgcctgcacccaggtgaaataaacagccttgttgctcacacaaagcctgtttggtggtctcttcacagggacgcgcatgaaatttggtgtcgtgactcagatcgggggacctcccttaggagatcaatcccctgtcctcctgctctttgctctgtgagaaagatccacctacgacctcaggtcctcagaccgaccagcccaagaaacatctcaccaatttcaaatccggtaagcggcctctttttactctcttctccagcttccctcactatccttcaacctctttctcctttcaatcttggcgccacacttcaatcactcccttctcttaatttcaattcctttcattttctggtagagacaaaggagacacgttttatccgtggacccaaaactccggcggcggtcacggactgggaaggcagccttcccttggtatttaatccttgcagggacacctctctgattattcacacacatttcaaaggtgtcagaccaagcagggacacctgccttggtccttcacccttagtggcaagtcccgcttttctgaggaaggggcaagtaccccaaccccttctctccttgtctctaccccttctctgcttttctgggggaggggcaagtacccctcaaccccttctccttcacccttagcggcaagtcccgcttttctagggggcaagaacacccaatcccttatttctgtgccccaccctcttatctctgtgccccaattccttatttccatgccccaaccctttctctgcttttctggagggcaagaaccccccaccccttctccgtgtctctgctcttttctctgggcttgcctcctttactatgggcaagcttccaccttccattcctccttcttctcccttagcctatattcttaagaacttaaaacctcttcaactctcatctgacctaaaatctaagcatcttattttcttctgcaatgccgcttgaccccaatacaaactcgacagtagttccaaatagccggaaaatggcactttcaatttttccatcctacaagatctaaataattcttgtcctaaaattgacaaatggtctgaggtgcctgatgtccaggcattcttttacacatcagtcccttcctagtctctgtgcccagtgcaactcgtcccaaatcttccttctttccctcccacctgtcccctcagtcccaaccccaagcgtagctgagtctttctaatcttccttttctacagacccatctgacctctcccctccttgccaggccaagctaggtcccaattcttcctcagcctctgctcctccaccctgtaatctttttatcgcctcccctcctcacacctggtccggcttacagtttcattctctgactagccctcccccacctgcccacaatttactcttaaaaaggtggctggagccaaaggcatagtcaaggttaatgctcctttttctttatcccaaatcagaagcatttaggctcttttttatcaaatataaaaacccagcccagttcatggctcgttcggcagcaaccctgagatgctttacagccctagacggtaaaatgtcaaaaggccgtcttattctcaatatacattttattacccaatctgccccggacattaaataaaactccaaaaattagaatctggccttcaaaccccacaacaggacttaattaacctctccttcaaggtgtacaataataaaaaaaaaagttgcaattcctcgcctccactgtgagacaaaccctagccacatctctagcatacaagaacttccaaacgcctgaaccgcagaggccaggtgttccttcagaacctcctcccccaggagcttgctacaagtgccagaaatctgaccaccaggccaaggaatgcctgcagcccaggattcctcctaagccgtgtcccatctgtgcgggaccccactggaaatcggactgttcagctcacctgacagccactgccagagcccctggaactctggcccgaggctctctgactgactccttcccagatcttcttggcttagtggctgaagactgatgctgcctgatcgcctcggaagccccctagaccatcacggacgccaagcttcaggtaactctcacagtggaaggtaagcccatccccttcttaatcaatacggaggctacccactccacattaccttcttttcaagggcccgtttcccttgcctccataactgttgtgggtattgacggccaggcttctaaacctcttaaaactccccaactctggtgccaacttagacagtactcttttaagcactccttttagttatccccagctgcccagttcccttattaggctgagacactttaaatcatctgcttccctgactattcctggactacagctatatctcattgccacccttcttcccaatccaaagcctcctttgcatcctcctcttgtatccccccaccttaacccacaagtataagatacctctactccctccttggcgaccgatcatgcaccccttaccatctcattaaaacctaatcacccttaccccactcaacgccaatatcccatccagcagcacgctttaaaaagattaaagcctgttatcactcgcctgctacaaaattgccttttaaagcctataaactctccttacaattcccccatttcacctgtcttaaaaccagacaagccttacaagttagttcaggatctgcgccttatcaaccaaattgttttgcctatccaccctgtggtgcccaacccgtacactcttttgtcctcaataccctcctccacaactcactattccgtgcttgatcttaaagatgcctttttccactattcccctgcacccctcgtcccagcctctctttgatctttgctggcaggactatgccgaatctccttaagcactctctaatcagatatcctaagtggtcccaattcttagaccttttatacctgtttttctccttctgttattccatttagtttttcaattcatacaaaaccgtatccaggccatcaccaatcattctatacaacaaatgtttcttctaacatccccacaatatcaccccttaccgcaagacctcccttcagcttaatctctcccactctagggtcccacgccgcccctaatcccgcttgaagcagccctgagaaacatcgaccattctctctctcgataccaccccccaaaaattttcgccgccccaacacttcaacactattttgttttgtttttcttattaatataagaaggcaggaatgtcaggcctctgagcccaagccaagccatcgcatcccctgtgacttgcacatatatgcccagatggcctgaagtaactgaagaatcacaaaagaagtgaatatgccctgccccaccttaactgatgacattccaccacaaaagaagtgtaaatggccggtccttgccttaagtgatgacattaccttgtgaaagtccttttcctggctcatcctggctcaaaaatcacccccactgagcaccttgcaacctccactcctgccctccagagaacaaaccccctttgactgtaattttcctttacctacccaaatcctataaaacggccccacccttatctccctttgctgactctgttttcggactcagcctacctgcacccaggtgaaataaacagccatgttgctcacacaaagcctgtttggtggtctctttacacggacgcgcatgaaa

SEQ ID NO: 297 - DNA, 377 bp, Homo sapiens
gtcaggtctctgagcccaagcctgcacgtattcattcagatggcctgaagcaagtgaagaatcacaaaagaactgaaaatggccggttcctgccttaactggtgacattaccttgtgaaattccttctcctggctcgtcctggctcaggagctccccgactgagcaccttgtgaccccccacttctgccagccagagaacaaacccctttgactgtaattttccactacctacccaaatcctataaaacggccccaccgctatcttccttcgctgactctctttttggactcagcccgcctgcacccaggtgattaaaaagctttattgctcacataaagcctatttggtggtctcttcacatggacgcgcatggaa

SEQ ID NO: 298 - DNA, 1595 bp, Homo sapiens
cgcggtcagaattcttacacaagagccaggaccacaccctgtagcctttctgtccaaacaacttgaccttactgttttagcctagccctcatgtctgcgtgcagcggctgccgctgctttaatacttatagaggccctcaaaataagtagaggcctttcatacagggtctgagaaggccaccgcagtcatttcttcccttctgtcagacataattcctcagtctagccttcccacctcaatacagtctgataacagacgagcctttattagtcaaatcagccaagcagtttttcaggctcttagtattcagtgaaacctttatatcccttatagtcctccatcttcaagaaaacacacctcaccaagctcagccaccaacttaaaaaggactggacaatacttttaccactttcccttctcagaattcaggcctgtcctcagaatgctacagggtacagcccatttaaggtcctgtatagatgctcctttttattaggccccagtctcattccagacaccagaccaacttagactgtgcctcaaaaaaaaaaaatcccaaaaaaaaaaacttgtcatccctactattttctgtctagtcatactgctattcaccgttctcaactactcatacatgccctgctcttgtttacactgccagtttacactgtttttccaagccatcacagctgatatctcctggtgctatccccaaactgccactcttaactcttgaagtacataaataatctttgctggcaggactatgctgaatctccttaggcactctctaatcagacatcctgagttgtcccaattcttaggccttttatacctgtttttctccttctgttatttcatttagtttttcaattcatacaaaaccgtatccaggccatcaccaatcattctatatgacaaatgtttcttctaacatccccacaatatcacgccttaccacaagacctcccttcagcttaatctctcccactctaggttcccacgccgcccctaatcccgctcgaagcagccctgagaaacatcgcccattctctctccataccaccccccaaaaaattttcaccgccccaacacttcaacactattttgttttatttttcttattaatataagaaggcaggaatgtcaggcctctgagcccaagccaagccatcgcatcccctgtgatttgcacgtatatgcccagatggcctgaagtaactgaagaatcacaaaagaagtgaatatgccttgccccaccttaactgatgacattccaccacaaaagaagtgtaaatggccggtccttgccttaactgatgacattaccttgtgaaagtccttttcctggctcatcctggctcagaaagcacccccactgaacaccttgcgacccccactcctgcccgccagagaacaaaccccctttgactgtaattttcctttacctacccaaatcctataaaacggccccacccttatctcccttcgctgactctcttttcggactcagcccgcctgcacccaggtgaaataaacagccatgttgctcacacaaagcctgtttggtggtctcttcacacggacacgcatgaaa

SEQ ID NO: 299 - DNA, 690 bp, Homo sapiens
taggtagtcaagcagacctaagcagggcaggagagcccctactgccccccaaccaagaatgtcagacaaccatcaggtgatggtcaggcggttatcaaactgcttctctaaaataataattggttgcagctggcatcaggaaaaggcagtctcccaagagatagaaacacttaaagttggtgatcagcagcttcccagtaggatctcaggagttggttgagtggtctcaagcatgcacactaagaggcaaatggcagagtttaactggtatatgaccttcctttaggaacactcaactggtaaggaaaaaacccctcaagtgagcatgtgcacaattttggtaaacacactgtgcatacagcccctttcaagtgttggcagtccactatgcctgcggacagcccaccccaaagaagaatcagggaagaaggattgcaagaccccagaagcatgccaatgtataagaccccaagtcaaaggtcaaacagtgcacttcaatctctcaagttgctggcttggccctcttccaggtgtactttacttccttttgttccctctaaacttgttagtgaactttcattcctgctctaaaacttgcctaggtctttcactctgccctatgccccttggtcaaattctttcttctgaggaggcaagaattgaggttgttgtagacctgtacaggttcgc

SEQ ID NO: 300 - DNA, 567 bp, Homo sapiens
tctgggaggtgtacccaacagctcattgagaacgggccatgatgacaatggcggttttgtggaatagaaaggcgggaaaggtggggaaaagattgagaaatcggggcggtttcgtggaatagaaaggcgggaaaggtggggaaaagattgagaaatcggatggttgctgtgtctgtgtagggagaagtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctactcttaagtacccagggacacaaacactgcggaaggccgcagggtcctctgcctaggaaaaccagagacctttgttcacttgtttatctgctgaccttccctccactattgtcctatgaccctgtcaaatccccctctgcgagaaacacccaagaatgatcaataaa

SEQ ID NO: 301 - DNA, 1021 bp, Homo sapiens
gtggggaaaagagagatcagactgttactgtgtctgtgtagaaagaagtaggcataagagactccattttgctctgtactaagaaaaattcttctgccttgagatgctattaatctgtaaccctacccccaaccctgtgctcacagagacaagtgctgtgttaactcaaggtttaatggatttagggctatgcaggatgtgctttgttaaacaagtgcttaaaggcagtatgcttgttaaagtcatcaccagtctctaatctcaagtacccagggacacaatacactgctgaaggccgcagggacctctgcctaggaaagccaggtattgtccaaggtttttccccatgtgatagtctgagatatggcctcatgggaagggaaagacctgaccgtcccccagcctgacatgggtaaagggtctgtcctgaggaggattagtaaaagaggaagacctctttgcagttgagataagaggaaggcatctgtctccaggcatgtgtctttatagtagaatatagtagaatgatttatattattcccggagagtgatttatattattccctgggcaatggaatgtctcggtgtaaaacccgattgtatgttccatatactgagataggagaaaactgccttaaggctgcaggtgagacatgctggcggcactactctttaatgcaccagagatgtttatgtatgtgcacatcaaagtacagcaccttttctaaccttgtttatgacacagagatatttgttcacgtgttttcctgctgaccctctccccactattaccctattgtcctggaacatccccctctcttgagatggtagagataatgatcaataaatactgagggaactcagagaccggtgctggcacgggtcctccacatgctgagcgccgcccctgggcccacttttctttctctatactttgtctctgtgtctctttcttttctcagtctctcgtcccacccgacgagaaacacccacaggtgtggaggggcaggccaccccttca

SEQ ID NO: 302 - DNA, 751 bp, Homo sapiens
gagagacaggactagctggatttcctaggccgactaaggattcctaagcctagctgggaaggtgaccgcatccacctttaaacaagtggcttgcaacttagctcacactcaaccaatcaggtagtaaagacagctcactaaaatgctaattaggctaaaacaggaggtaaagaaatagccaatcatctatcgcctgagagcatggtggggggggggggcggggacaatgattggaatataaacccaggcattcgagcaggaacttcaacaccctttgggtcccctcccattttatgggagctctgttttcaccctattaaatcttgcaactgcacactcttctggtccgtgtttgttatggcttgagcagagcttttgctccagtccaccactgctgtctgtggctgttgcagacctgctgctgactttggtaggatgtccgctgtgctcctgatctagccaggcgctcattgctgctcccaagcggctaaaggcttgccattgttcctgcatggctaaatgcccaggttcatcctaatcgagctgaacactagtcgctgggttccacggttctcttccgtgacccacggcttctaatagagctataacactcactgcgtggccccagattccattccttggaatctgtgaggccaagaaccccaggtcagagaacaagaggcttgctgccatcttgaaagtggcccgccaccatcttgggagctctaagaacaaggacaccctgataaca

SEQ ID NO: 303 - DNA, 688 bp, Homo sapiens
ttatagtaggtagctagtcaggcatgagcagggcaggagagggttccacctgaccaggaatgtcaggtgaccatcaggtgatggacaggaggttgttaaatgtttctctaaaatagtaattggtcacagccagtgaaagggaaaggcagtctccatatagatagaaaaaaacctgcaactggtgatcagcagcttcccaataagatctgaagagatgggtgagtgagctcaagcatgcacattaagaggcaaaatggtggagtttaactggtatatgaccttcctctaggaatgctagactggtaagggaagaatgcctcaagtgagtatgggcacaactccagtaagcacactgcacaggctcctctcccaagcgctagcaggccactgcgcatgtgaacagcccaccccaagggaagaatcaggggagaagggacacaagaccctggacgtaccaatgtataaaacctcaagtcaaaaggccaaactgcacaataaccgttcgagtcaccagcttggccctcttccaggtgcgcgttccttccttctgttcctgctctaaaactttttaataaattttcactcctctaaaacttctcggtctccctaccttatgcccctcggccgaattctttcttctgaggaggtaagaattgaggttgctgcagatgcatcagattcgctactg

SEQ ID NO: 304 - DNA, 937 bp, Homo sapiens
gtggggaaaagaaagagacatcagactgttactgtgtctacgtagaaagaagtagacataagagattccattttgttctgtactaagaaaaattcttctgccttgagatgctgtgctggcagaaacgtgctgtgttgactcaaggtttaatggatttagggctatgcatgatgtgctttgttaaacaaatgcttgaaggcagcatgcttgttaaaagtcatcaccactccctaatctcaagtacccagggacacaaaacactgtggaaggcggcaggaacctctgcctaggaaagccatgtattgcccaaggtttctccccaggtgatagtctgaaatatggcctcgtgggaagggaaagttctgaccgtccccagcccgacacccataaatggtctgtgctgaggaggattagtgaaagaggaagacctctttgcagttgagataagaggaaggcgtctgtctcctgcccctccctgggcaatggaatgtcttggtgtaaaacctgatcgtatattccatctactgagataggagaaaactgccttagggctggaggtgagacatgctggcagcaatactgctctttaatgcaccgagatgtttatgtatgtgcatatcaaagcacaacacctttttcttaaccttgtttatgatacagagacatttgttcacatgttttcctgctgaccctctctctccccactattaccctattgtcctgccacatccccctctctgagatggtagagataatgatcaatactgaggggactcagaaactggtgccagcgtgggtcctccctttgctgagcgctggtcccctgggcccacttttctttctctatactttgtctctgtgtctctttgttttctcagtctctcatcccaccaaaggagaaacacccacaggtgtggaggggcaggccaccccttca

SEQ ID NO: 305 - DNA, 323 bp, Homo sapiens
ttgctcacacaaagcttgtttggtggtctcttcacacggacgtgtatgaaatttggtgccgtgaccccaacccttaagaaggttgtttgtaattctccccacccttgagaatgtactttgtgagatccacccctgcccaccagagaacaaccccctttgactgtaattttccattaccttcccaaatcctataaaatggccccaccccatctccctttgctgactcttttcggactcagcccgcctgcacccaggtgaaataaacagccatgttgctcacacaaagcctgtttggtggtctcttcacacggacgcatatgaaa

SEQ ID NO: 306 - DNA, 1199 bp, Homo sapiens
cccctcccttccctacacatcaagcttggggatttgcccctgcccaggactggcaaattgactttactcatatcaggaaactaaaatgcctcttggtctagttagacactttcactgtatgggtagaggcctttcccacagggtctgaaaaggccaccgcggttatatcttcccttctgtaagacataatacctcagtttggtcttcccacctctatacagtccagtaacagaccggcctttattaatcaaatcacccaagcagtttctcaggctcttggtattcagtggaactttcatgcaccttactgtcctcaatcttcaggaaacgtagaatggactaatggtcttttaaaaacacgcctcatcaagctcagcctccaacttaaaaaggagaactctgacaaggatagagcccaaaaacttacgctgaacccccttggccactctctaagtgtatgtcctgggtcctcccaattcttagtccttaaatacctgtttttctctttctcttattcagatcttgtatcttctgtttagtttctcagttcatacaaaaccacatctaggccatcaccaatcattgtatatgacaaatgcttcttttaacaaccccacaatattgcctcttaccacaaaatcttccttcggcttaatctctcccactctacgttcccacgctgccccaatcccactgacagcagccctgagaaacatcgcccattatctctccataccacctcccaaaattttcgccactccaacacttcaacactattttgttttatttttcttattaatataaaagacaggaatgtcaggcctctgatccgagctaagccatcatatcccctgtgacctgcacgtatacatccagacagcctgaagcaactgaagaatcacaaaagaagtgaaagtggctggttcctgccttaactgatgacattaccttgtgaaattccttctcctggctcagaagctccccactgagcaccttgtgacccctgcccctgctgccagagagcaaccccctttgactgtaattttccactacccacccaaatcctataaaatggccacaccccatctcccttcactgactctctttttggactcagcccgcctgcacccaggtgattaaaaagctttattgccacacaaagcctgtttggtggtctcttcacatggactcgcatgaaa

SEQ ID NO: 307 - DNA, 6028 bp, Homo sapiens
gtcaggcctctgagcccaagccaagccatcgcatcccctgtgacttgcacatatacgcccagatggcctgaagtaactgaagaatcacaaaagaagagaaaaggccctgccctgccttaactgatgacattccaccattgtgatttgttcctgccccaccattaaccctgtgaatttccttctcctggctcagaagctccccaactgagcaccttgtgacccctacccctgcccaccagaaaacaaccccctttgactgtaattttccattaccttcccaaatcctataaaacggccccacccctatctcccttcgctgactctctttttggactcagcccgcctgcacccaggtgaaataaacagccatgttgctcacacaaagcctgtttggtggtctcttcacatggacgcgcatgaaatttggtgctgtgactcgaattgggggacctcccttgggagatcaatccgctgtactcctgttctttgctccgtgagaaagatccacctatgacctcaggtcctcagaccgaccagcccaaggaacatctcaccaattttaaatcaggtaagcggcctcttcttactctcttctccaacctctctcactgtccctcaaccactttctcctttccactcttcaatctctcccttctcttaatttcaattcctttcattttctgggagagacaaaggagacacattttatccgtgcacccaaaactctggcgccggtcacggactgggaaggcagccttcccttggtgtttaaacattgcagggacgcctctctgattatacacccacgtttcaaaggtgtcagatcacgcagggacgcctgccttggtccttcacccttagtggcaagtcctgcttttctggggaaggggcaagtaccccaaccccttctctccttgtctctaccccttctctgcttttctgggggaggggcaagtacccctcaactccttctccttcacccttagcggcaagtcccgcttttctgggagaggggcaagtacccctcaaccccttctccttcacccttagtggcaagtcccgcttttctgggggaggggcaagtacccctcaaccccttctccttcacccttagtggcaagtcccgcttttctgggggaggggcaagtacccctcaaccccttctccttcactcttagcggcaagtcctgcttttctagaggaggggcaagtaccccaacctcgtatctctgcgccccaatcccttatttccacgcccctacctcttatctctgcgccccaatcccttatttctgtgccccgaccccttatttccatgccccaaccccttatttctgtgccccatcccttatttccgtgccccgacctcttatctctgcgccccaaccccttttcccacttttctggaaggtaagaaccgccgaaccccttctctctgtttctctactctctcttttctctaggcttgcttccttcactatgggcaaccttccaccctccattcctccttctactcccttggcctgtgttctcaaaaacttaaaacctcttcaactcacacctgacctaaaacctaaatgccttattttcttctgcaatgccacttgaccccaatacaaactcaacagtagttccaaatagccagaaaatggcactttgaatttctccatcctgcaagatctaaataattcttgtcgtaaaataggcaaatggtctgaggtgcctgacgtccaggcattcttttacacatcagtcccttcctagcctctgtgcccagtgcaactcgtcccaaatcttccttctttccctcccgcctgtcccctcagtaccaaccccaagcgtcgctgagtctttctaatcttcattttctacagacccatctgacctctcccttcctccccaggctgctcctcgccaggccgagctaggtcccaattcttcctcagcctctgcttctccaccctataatccttttatcacctcccctcctcacacctggtccggcttacagtttccttccgtgactagccctcccccacctgcccagcaatttactcttaaaaaggtggctggagctaaaggcatagtcaaggttaatgctcctttttctttatcccaaatcagatagcatttaggctctttttcatcaaatataaaaacccagcccagttcatggctcgtttggcagcaaccctgagacgctttacagccctggaccctaaaaggtcaaaaggccgtcttattctcaaaatacattttattacccaatctgctcccgacattaaataaaactccaaaaattaaattccggccctcaaaccccacaacaggatttaattaacctcgccttcaaggtgtacaataatagaaaaaagttgcaattccttgcctccactgtgagacaaaccccacaacaggatttaattaacctcgccttcaaggtgtacaataatagaaaaaagttgcaattccttgcctccactgtgagacaaaccccagccacatctccagcacacaagaacttccaaacgcctgaaccgcagcggccaggcgttcctccagaacctcctcccacaggagcttgctacatatgctggaaatctggccactgggccaaggaatgcccgcagcccgggattcctcctaagccgcatcccatctgtgtgggaccccactgaaaatcggactgttcaactcacctggcagccactcccagagcccctggaactctggcccaaggctctctgactgactccttcccagatcttctcggcttagcggctgaagaccgacactgcccgatcacctcggaagccccctagaccatcacggacgccaagcttcaggtaactcacagtggaaggtaaggccgtccccttcttaatctatacggaggctacccactccacattaccttcttttcaagggcctgtttcccttgcctccataactgttatgggtattgacagccaggcttctaaacctcttaaaactccccaactctggtgccaacttagacaatacccttttaagcactcctttttagttatccccacctgcccagttcccttattaggctgacgctttaactaaattatctgcttccctgactattcctggactacagctatatctcattgccgcccttcttcccaatccaaagcttcctttgcgtcctcctcttgtatccccccaccttaacccacaagtataagatacctctactccctccttgcacctcttaccatctcattaaaacctaattacccttaccccactcaacgccaatatcccatcctgcagcacgctttaaaaagattaaagcctgttatcactcgcctgctacagcatggccttttaaagcctataaactctcgttacaattcccccattttacctgtcctagaaccagacaagccttacaagttagttcaggatctgcgccttatcaaccaaattgttttgcctatccaccccgtggtgccaaacccatatactctcctatcctcaatacctgcctctacaacccattattctgttctggatctcaaacatgctttctttactattcctttgcacccttcatcccagcctctctttgctttcacttggactgaccctgacacccatcaagctcagcaagttacctaggctctactgccacaaagcttcacagacagcccccattacttcaatcaagcccaaatttcttcctcatctgttacctatctcggcataattctcataaaaacacacgtgctctccctgccaatcgtgtccgactgatctctcaaaccccagcaccttctacaaaacaacaactcctttccttcctaggcatggttagcgcagtcagaattcttacataagagccaggaccacaccgtgtagcctttctgtccaaacaacttgaccttactgttttagcctagccctcatgtctgcgtgcagcggctgccgctgctttaatactgttagaggccctaaaaatcacaaactatgctcaactcactctctacatttctcatagcttccaaaatctattttcttcctcatacctgatgcatatactttctgctccccggctccttcagctgtgctcgctctttaagtcccacaatgaccattgttcctggtccggacttcaatctggcctcccacattattcctgataccacacctgacccccatgactgtatttctctgatccacctgatattcaccccatttccccatatttcattctttcctgttcctcaccctgataacgcttgatttattgacggcagttccaccaggcctaattgccacacaccagcaaaggcaggctatgctatagtacaagccactagcccgcctctcagaacctctcatttcctttccattgtggaaatctatcctcaaggaaataacttctcagtgttccatctgctattctactactcctcagggattattcaggccccctcccttccctacacatcaagctcgaggatttgtccccacccaggactggcaaattagctttactcaacatgtcccgagtcaggaaactaaaatacctcttagtctaaatagacactttcactgaataagtaaaggcctttcctacagggtctgagaaggccaccacagtcatctcttcccttctgtcagacataattcctcagtttagccttcccacctctatacagtctgataacagaccagcctttattagtcaaatcagccaagcagtttttcaggctgttagtattcagtgaaacctttatatcccttacggtcctccgtcttcaagaaaagtagaacggactaaaggtcttttaaaaacacacctcaccaagctcagctaccaacttaaaaaggactggacaatacttttaccactttcgcttctcagaattcaggcctgtcctcagaatgctacaaggtacagccaatttaagctcctgtatagacgctcctttttattaggccccagtctcattcgacaccagaccaacttagactgtgccccaaaaaaacttgtcatccctactatcttctgtctagtcatactcctattcaccgttctcaactactcatacatgccctgctcttgtttacactgccggtttacactgtttctccaagccatcatagctgatatctcctggtgctatccccaaactgccacacttaactcctgaagtaaacaaacaatcttggctggcaggactatgctgaatctccttaggcactctctaatcagatgtcctaggtcctcccaattcttagaccttttatacctgtttttctccttcttttattccatttagtttttcaattcatacaaaactgtatccaggccatcaccaatcattctataagacaaatgtttcttctaacaaccccacaatatcaccccttaccacaaaatcttccttcagcttaatctctcccactctaggttcccacgccgcccctaatcccgctcgaagcagccctgagaaacatcgtccattctctctccataccacccccaaaaattttcgccgccccaatacttcaacactattttgttttatttttcttattaatataagaaggcaggaatgtcaggcctctgagcccaagccaagccatcgcatcccctgtgacttgcacgtatacgcccagatggcctcaagtaactgaagaatcacaaaagaagtgaaaaggccctgccccgccttaactgatgacattccaccattgtcatttgttcctgccccaccttaactgagtgattaaccctgtgaatttccttctcctggctcagaagctcccccactgagcaccttgtgacccctacccctgcccaccagagaacaaccccctttgactgtaattttccattaccttcccaaatcctataaaacggccccaccccatctcccttcactgactctcttttcggactcagcccgcctgcacccaggtgaaataaacagccatgttgctcacacaaagcctgtttggtggtctcttcacatggacgcgcatgaaa

SEQ ID NO: 308 - DNA, 965 bp, Homo sapiens
gtggggaaaagaaagagagatcagattgttactgtgtctgtgtagaaagaagtagacacaagagactccattttgttctgtactaagagaaattcttctgccttgagatgctgttaatctgtaaccttacccccaaccctgtgctccctgaaacatgtgctgtgtcaactcagggttaaatggattaagggctgtgcaagatgtgctttgttaaacaaatgcttgaaggcaaatgcttgaaggcagcagtggttaagagtcatcaccactccctaatctcaagtacccagggacacaaaaccctgcagagacctctgcctaggaaagccaggtatcgtccaaggtttctccccatgtgatagtctgaaatatggcctcgtgggaagggaaagacctgaccgtcccccagcccgacacctgtaaagggtctgtgctgaggaggattagtaaaagaggaaggaacgcctctttgcagttgagacatgaggaaggcatctgtctcctgcccatctctgggcaatggaatgtctcagtataaaaccagattgtatgttccatctactgagatggggaaaactgccttagggctggaggtgggacaggcgggcagcaatactgctctttaaggcattgagatgtttatgtgtatgcatatctaaagcacagcacttaattctttaccttgtctatgatgcagagacctttgttcacgtgcttatctgctgactttctctcattatcctatgaccctgccacatccccctctccgagaaacacccaagaatgaccaataaatactaagggaactcagaggccggcgagatcctccgtatgctgaacgctggtcccctgggcccccttttttccttctctatactttgtctctgtgtctctttcttttccaagtctcttgttccacctaacgagaaacgcccacaggtgtggaggggcaaaccaccccttca

SEQ ID NO: 309 - DNA, 798 bp, Homo sapiens
cccacagtaggctttaaagggactgaagcctgttatcactcgcctgctacagcttgggcttctaaagcctacaaactctccttacaattcccccattttacctgtcccaaaactggacaagtcttacaggttagttcaggttctgcaccttatcaaccaaattgttttgcctatccaccctgtggtgccaaacctgtacactcttttgtcctcaataccttcctccacaactcactattccattcttgatcttaaagatgcctttttcactattcccctgcacccctcgtcccagcctctctttgcttttacctggactgaccctgacacccatcagtcccagcagcttacctgggctgtactgccgcaagtcttcaggaacagccctcattacttcagccaagccctttctcatgatttactttctttctacccctctgcttctcaccttattcaatatattgatgaccttctactttgtagcctctcctttgaatcttctcagcaagacaccctcctgctccttcaacatttattctccaagggatatcaggtctcttcttccttactctactctttacaacagggctttatgaagtcacccccgccttcttggactgcacctcacaaacttacaccactatccatcatctacccaactcctataaaacaaccccttccccatctccctttgctgactccgtttttagactcagtccacctgcacccaggtgattaaaaagctttattgctcacacaaaacttgttcggtggtctcttcacacgggcaccgcgtga

SEQ ID NO: 310 - DNA, 582 bp, Homo sapiens
agggaaagacctgaccatcccccagccggacacccataaagggtctgtgctgaggaggattagtgaaagaggagggcatctttgcagttgaggtaagaggaaggcatctgtctcctgctcatccctgggcaatggaatgtctccgtgtaaaacccgattgtatgttctatttactgagataggtgaaaactgccttaaggctggaggtgagacacgctggcagcaatactgctctttaatgcaccgagatgtttgcgtacgcgcacaccaaagcacagcaccttttcttaaccttgtttatgacagacctttgttcacatgttttcctgctgaccctctccccactattaccctactgtcctgccacatccccctctctgagatggtaaaaataatgatcaataaatactgagggaactcagagaccagtgctggcgcaggtcctccatatgctgagcgctggtcccctgggcccacttttctttctgtatactttgtctctgtgtctttttcttttctcagtctttcatcccacctgaggagaaacgcccacaggtgtggaggcgcaggccccccccttca

SEQ ID NO: 311 - DNA, 3832 bp, Homo sapiens
gtcgggcctctgggcccaagccaagccattgcatcccctgtgacttgcacgtatacgcccagatggcctgaagtaactgaagaatcacaaaagaagtgaatatgccctgccccaccttaactgatgacattccaccacaaaagaagtgtaaatggccattccttgccttaactgatgacattaccttgtgaaagtccttttcctggctcatcctggctcagaaagcacccccactgagcaccttgcgacccccactcttgcccgccagagaacaaaccccctttgactgtaattttcctttacctacccaaatcctataaaacggccccacccttatcttcctttgctgactcttttcagactcagcccacctgcacccaggtgaaataaacagccatgtagctcacacaacgcctgtttggtggtctcttcacacggacgcacatgaaatttggtgccctgactcggatcgggggacctcccttgggagatcaatcccctgtcctcctgttctttgctccctgagaaagatccacctatgacttcaggtcctcagactgaccagcccaaggaacatctcaccaattttaaatcaggtaagcagcctcttcttactctcttctccaacctctctcactgtccctcaaccactttctcctttccactcttcaatctctcccttctcttaatttcaattcctttcattttctgggagagacaaaggagacacgttttatccgtggacccaaaactccggcgcaggtcacagactgggaaggcagccttcccttggtgtttaatcattgcaggggcacctttctgattatacacccacgtttcaagggtgtcagaccacgcagggacgcctgccttggtccttcacccttagcggcaagtcccgcttttctggggaaggggcaagtaccccaaccccttctctccttgtctctaccccttctctgcctttctgggagaggggcaagtacccctcaaccccttcgccttcacccttagcggcaagtcccacttttctgggagaggggcaagtacccctcaaccccttctccttcacccttagtggcaagtcctgcttttctacggggcaagaacccccaatcccttatttccgtgccccaacctcttatctctgcaccccaatcccttatttccatgtcccacctcttatctctgtgccccaatcccttatttccgtgccccaacctcttatctctgtgccccaatcccttatttccgtgccccaacctcttatctctgcgccccaatcccttatttctgcaccccgacctcttatctctgtgccccaatcccttatttctgtgccccaacctcgtatctctgcgcccaaatcccttatttccgtgtcccaacctcatatctctgttccccaatcccttatttctgcaccctgacctcttatctctcagcccgaaccccttttcccacttttctggaaggtaagaacccccgaaccccttccctccatttctctactctctcttttctctaggcttgcttccttcattataggaaaccttccaccctccattcctccttctactcccttggcctgtgttctcaaaaatttaaaacctcttcaactcacacttgacctaaaacctaaatgccttattttcttctgcaatgccgcttgaccccaatacaaactcgacagtagttccaaatagccagaaaatggcactttgaattttcccatcctgcaagatctaaataattattgtcgtaaaataggcaaacggtctgaggtgcctgacatccaggcattcttttacacatcagttccttcctagtctctgtgcccagtgcaactcgtcccaaatctttcttctttccctcccacctgtcccctcagtaccaaccccaagcgtcgctgagtctttctaatcttccttttctacagacccatctgacctctcccttcctccccaggctgctcctcgccaggccgagctaggtcccaattcttcctcagcctctgctcctccaccctataatctttttatcgcctcccctcctcacacctggtctggcttacagttttgttcgtgactagccctctccctcctgcccagcaatttactcttaaaaaggtggctggagctaaaggtatagtcaaggttaatgctcctttttctttatcccaaatcagatagcatttaggctctttttcatcgaacataaaaatccagcccagttcatgacttgtttggcagcaaccctgagacactttacagacctagaccctaaaaggtcaaaaggccgtcttattctcaaaatacattttattacccaatctgctcccgacattaaataaaactccaaaaattaaattccggccctcaaaccccacaacaggatttaattaaccttgccttcaaggtgtacaataatagaaaaaagttgcaattccttacctccactttgagacaaaccccagccacatctccagcacataagaacttccaaatgtctcaactgcagcggccaggcgttcctccagaacctcctcccacaggaacttgctacacgtgctggaaatctggcaactggaccaaggaatgcccgcagcccgggattcctaagccgcatcccatctgtgtgggaccccacggaaaatcggactgttcaactcacctggcagccactcccagagcccctggaactctggcccaaggctctctgactccttcccagatcttctcggcctagcggttgaagactgacactgcccaatcacctcggaagccccctagaccatcacggacgccgagcttcaggtaactctcacagtggaaggtaagcccgtccccttcttaatcaatacagaggctacccactccacattacttccttttcaagggcctgtttcccttgcctccataactgttgtgggtattgacggccaggcttctaaacctcttaaaactgcccaattctgctgccaacttagacaatactcttttaagcactcctttttagttatccccacctgcccagttcccttattaggctgagacactttaactaaattatctgcttccctgactattcctggactacagctatatctcattgccgcccttcttccctatccaaagcctcctttgcatcctcctcttgtatccccccaccttaacccacaagtataagatacctctactccctccttggcgaccgatcatgcaccccttaccatctcattaaaacctaatcacccttaccccactcaacgccaatatcccatcccacagcacgctttaaaaagattaaagcctgttatcactcgcctgctacagcatggccttttaaagcctataaactctccttacaattcccccattttacctgtcctaaaaccagacaagccttacaagttagttcaggatctgcgccttatcaaccaaattgtttttcctatcccccccgtggtgccaaacccatatactctcctatcctcaatacctgcctctataacccattattctgttctggatctcaaacatgctttctttactattcctttgcacccttaatcccagcctctcttcgctttcacttggactgaccctgacacccattaagctcagcaaataacctaggctgtactgccgcaaggcttcacagacagcccccattacttcaatcaagcccaaatttcatcctcatctgttacctatctcggcataattctcataaaaacatacgtgctttccctgctgatcctgtccgactaatctcccaaacctcaatcctttacaaaacaacaactcctttccttcctaggcatagttag

SEQ ID NO: 312 - DNA, 381 bp, Homo sapiens
gtcagacctctgagcccaagctaagccatcatatcccctgtgacctgtgcagatggctggttcctgccttaactgatgacattccaccaccaaagaagtgaaaatggcctgttcctgcctcaactaatgacattatcttgtgaaattccttctcctggctcatcctggctcaaaagcttccctactgagcaccttgtgacccccactcctgcccgccagagaaccacccccctttttcctttacctaaccaaatcctgtaaaacagccccaccccgtatctcccttcgctgactctctttttggactcagcccgcctgcaaacagctttattgctcacacaaagcctgtttggtggtctcttcacacggacgtgagtgaaa

SEQ ID NO: 313 - DNA, 5531 bp, Homo sapiens
gtcaggtctctgagcccaagctaagccatcatatcccctgtgacctgcacgtacacatccagatggccggttcctgccttaactgatgacattccaccacaaaagaaatgaaaatggcctgttcctgccttaactgatgactttatcttgtgaaattccttctcctggctcattctggctcaaaagctcccctactgagcaccttgtgacccccactcctgcctgccagagaacaaccctcctttttcctttacctacccaaatcctataaaacagccccacccctatctcccttcgctgactctcttttcggactcagcccacctgctcccaggtggaataaacagctttattgctcacacaaagcctgtttcatggtctcttcacacgaacacaagtgaaatttggtgccgtgactcagatcgggggacctcccttgggtgatcaatcccctgtccttctgctctttgctctgtgagaacgatccacctatgacctcaggtcctcagactgaccagcccaagaaacatctcaccaatttcaaatccggtaagcagcctctttttactctcttctccaacctccctcactatccctcaaactctttctcctttcaatcttggtgccacacttcaatctctcccttctcttaatttcaattcctttcattttctggtagagacaaaggagacacgttttatctgtggacccaaaactctggtgccagtcacggactagggaaggcagccttcccttggtgtttaatcattgcagggatgcctctctgattattcacccaggtttcagaggtgtcaaaccacgcaaggatgcctgccttggtccttcacccttagcagcaagtcctgcttttctgggggaggggcaagaatcccaaccccttctctccgtgtctctaccccttctctgcttttctgggggaggggcgagaacccctcaaccccttctccttcacccttagcggcaagtcccgcttttctgggggaggggcaggaaccctgacctcttatctctgcaccctgatccctcatttccgtgccccaacctcttatctctgcatcccaatctcttatctctgtgccccaaccccttatttctgcccccccgaccccttctctgcttttctggagggcaagaaccccccaccccttctccatgtctctactctcttttctctgggcttgctccttcactatgggcaagcttccaccttccattcctccttcttctcccttagcctgtgttcttaagaacttaaaaccttttcaactctcacctgacctaaaatctaagtgtcttattttcttctgcaatgccgcttgaccccaatacaaactcgacagtagttccaaatagccagaaaatggcactttcaatttttccatcctacaagatctaaataattcttgtcataaaataggcaaacagtctgaggtgcctgacatccaggcattcttttacacattgggccctccctagtccctgttcccaatgcaacttgtcccaaatcttccttctttccctcccgcctgtcccctcagtcccaaccccaagtgtccctgagtctttctaaccttccttttctacagacctatctgacctctcccctcttcaccaggctaagctaagtcccaattcttcctcagcctccgctcctccaccctataatccttttatcacctccccttctcacaccctgtccagcttacagtttcgttctgtgactagccctccccaacctgcccagcaatttcctcttaaaaaggtggctggatctaaagtcatagtcaaggttaatgctcctttttctttatcccaaatcagatagtgtttaggctctttttcatcaaatataaaaacccagcccagttcatggcttgtttggcagcaaccctgagatgctttacagccctagaccctaaaaggtcaaaaggccgtcttattctcaatatacattttatttacccaatctgctcccgacattaaataaaactccaaaaattaaattccggccctcaaactccacaacaggacttaattaacctcgccttcaaggtgtataataatagagaaaagttgcaattccttgcctccactgtgagacaaaccccagccacatctccagcacacaagaacttccaaacgcctgaactgcagtggccaggcattcctccagaacctcctcccccaggagcttgctacgagtgccaaaaatctggccaccaagccaaggaatgcccgcagcccaggattcctcctaagccatgtcccatctttgtggaaccccactgaaaatcggactgttcaactcacctggcagctactcccagagcccctggaactctggcccaaggctctctgactgactccttcccagatcttctcagcttagtggctgaagactgacgctgcccgatcacctaggaagccccgtagaccatcacggacgccaagctttaggtaactctcacagtggaggataagtccatccccttcttaatcaatacggaggctacctactccacattaccttcttttcaagggcctgtttcccttgcctccataactgttgtgggtattgacgggcaagcttcaaaacccctgaaaactccccaactctggtgccaacttggacaatactcttttatgcactcttttttagctatccccacctgcccagttcccttattaggccgagacactttaactaaattatctgcttccctgactattcctggattacagctacatctcattgctgcccttcttcccaatccaaagcctcctttgaatcctcctcttgtatccccccaccttaacccacaagtataagatgcctctactccctccttggtgaccgatcatgcaccccttaccatctcattaaaacctaatcacccttaccccactcaatgccaatatcccatcccacagcacgctttaaaaagattaaagcctgttattactcgcctgctacagcatggccttttaaagcctataaactctccttaccattcccccattttacctgtcctaaaaccagacaagccttacaagttagttcaggatctatgccttatcaaccaaattgttttgcctatccaccccatggtgccaaacccatatactctcctatcctcaatacctccctccacaatccattattctgttctagatctcaaacatgctttctttactattcctttgcacccttcatcccagcctctcttcgctttcacttggactgaccctgacacccatcaggctcagcaaattacctaggctgtactgccgcaaagcttcacagacagcccccattacttcaatcaagcacagatttcttcctcatctgttacctatctcagcataattctcataaaaacacatgtgctctccctgctgattgtgtccggctaatctcccaaaccccaatcccttctacaaaacaactcctttccttcctaggcatggttagtgcggtcagaattcttacacaagagccaggactgcaccctgtagcctttctgcccaaacaacttgaccttactgttttagcctagccctcatgtctgtgtgcagcagctgccactgctttaatacttttagaggccctaaaaatcacaaactatgctcaactcactctccacagttctcataacttccaaaatctattttcttcctcccacctgacgcatataatttctgctcccaggctcctttagctatactcactcttcattgagtctcccacaattaccattgttcctggcccagacttcaatctggcctcccacattattcctgataccacacctgatccccatgactgtatctctctgctccgcctgacattcaccccatttccccgcatttccttctttcctgttcctcaccctgatcacacttagtttattgatggcagttctgccaggcctaatcaccacacaccagcaaaggcaggctatgctatagtacaagccactagcccgcctcttagaacctctcatttcctttccatcgtggaaatctatcctcaaagaaataacttctcagtgttccatctgctatactactacttctcggggattattcaggccccctcccttccctacacatcaagctcggggatttgcccccacccaggactggcaaattggctttactcaacatgctccgagtcagaaaactaaaatacctcttagtctaggtagacactttcactggataggtagaggcctttcccacagggcctaaggaggccaccacagtcatttcttctcttctatcagatgtaattcctcagtttggccttcccacctctatacagtccaatagcagaccggcctttactagtcaaatcacccaagcagtttctcaggctgctagtattcagtgaactaatggtcttttaaaaacacacctcaccaagctcagccaccaacttaaaaaggactagacaatttcccttctcagaattcaggcctgtcctcagaatgctataaggtacagcccatttgagctcctgtatagacgctcctttttattaggccccagtctcattccagacaccagaccaactcggactgtgccccaaaaaacttgtcatccctactatcttctgcctagtcatactcctattcactgttctcaactactcatacatgccctgctcttgtttccactgccggtttacactgtttctccaagccatcacagctgatatctcctggtgctatccccaaactgccactcttaactcttaaacaaataatctttgctggcaggactatgctgaatctccttaggcactctaattagatgtcctgggtcctcccaattcttagacttttaatacctgtttttctccttctcttattccatttagtttttcaattcatataaaactgtatccaggccatcaccaataattctaaatgacaaatgtttcttctaacagtcccacaatatcaccccttaccacaaaatcttccttcagcttaatctctcccactctacgttcccacgccacccctaatcccgctcaaagcagccctgagaaacattgcccattctctctccataccacccccaaaaattttcaccatctcaacactttaccactatttcattttatttttcttattaatataagaagacaggaatgtcaggcctctgagcccaagctaagctatcatatcccctgtgacctgcacgtacacatccagatggccggttcctgctttaactgatgatattatcttgtgaaattccttctcctggctcatcctggctcaaaagctcccctactgagcaccttgtgacccccactcctgcttgtcagagaacaacccccctttttcctttacctacccaaatcctataaaatggttccacccctatctcccttcgctgactcttttcggactcagcccacctgcacccaggtgaaataaacagctttattgctcacacaaagcctgtttggtggtctcttcaaacagacgcgagtgaaa

SEQ ID NO: 314 - DNA, 963 bp, Homo sapiens
gtgtgggaaagaaagagagatcagactgttactgtgtctgtgtagaaagaagtagacgtaagagactccattttgttctgtactaagaaaaattcttctgccttgagatgctgttaatctgtaaccctacccccaaccctgtgctccctgaaacatgtgctgtgtcaactcagggttaaatggattaagggctgtgcaggatgtggtttgttaaacaaatgcttgaaggcagcatacttgttaagagtatcaccactccctaatctcaagtacccagagcacaatacactggagaaggccgcagggacctctgcctaggaaagccaggtactgtccaaggtttctcccatgtgatagtctgaaatatggcctcgtgggaagggaaagacctgaccatcctccagcccgacccccataaagggtccctgctgaggaggattagtaaaagaggaaggaaggcctctttgcagttgagataagaggaaggcatctgtctcctgctcctccctgggcaatggaatgtctccctgtaaagcccgattgtatattccatctactgagataggggaaaactgccttaggggtggaggtgggaaatgctggcagcaatactgctgtttaaggcattgagatgtttatgtatatgcacatcaaaagcacagcactttttatcttgtttatgatgcagagacatttgttcacatgttttcctgctgaccttctctccactattaccctattgtcctgccacatcccctctccgagaaacacccgataatgatcaataaatactaagggaactcagaggccagtgccggcgcgggacctccgtatgcgaacgccggtcccctgggcccatttttctttctctatactttgtctctgtgtctctttcttttccaagtctctcgttccacctgatgagaaacgcccacaggtgtggaggggcaacccaccccttca

SEQ ID NO: 315 - DNA, 132 bp, Homo sapiens
tgccaacgtataaaaccccaagtcaaaccacacacttgactctctcaagtcacccacttagtcctcttccaagtgtattttacttcctttcattcctgctctaaagcttttaaataaatattcactcctgct

SEQ ID NO: 316 - DNA, 879 bp, Homo sapiens
aggcacccctacggaggaaatctcaactgcacaacccctactgtgccccaattcagcaggaagcagttagagcggtggtcaaacctccccaatagcacttgggttttcctgttgagagggggtactgagagacaggactagttggatttcctaggctggctaagaatccctaagcctagctgggaaattgaccacgtccacctttaaacacggggcttgcaatttagctcacacccgaccaatcaggtagtaaagagagctcactaaaatgctaattagggaaaaacaggaggtaaagaagtagccaatcatctatcgcctgagagcacaacaggagggacaatgatcaggatataaacccaggcattcaagccagcggtggctaccctctttgggtcccctccctttgtatggaagctctgttttcactctattaaatcttgcaattgcacacttttctggtacgtgtgtgtcacagctcaagctgagctttcgctcaccgtccaccactgctgtctgccgctgtcacagacccacagctgacttccatccctctggatccagcgaggcgcccattgctgctcctgatcgggctaaaggcttgcccttgttcctgcagggctaagtgcccaggttcgtcctaatctagctaaacactagtcactgggttccacgattctcttccatgacccacagcttctaatagagctataacactcgccgcttggcccaagattccattccttggaatccatgaggccaagaaccccaggtcagagaacacaagacttgccaccatctcggaagtggcccgtcaccatcttggaagcgacctgccaccatcttgggaacttggggagcaaggacccccagtaacat

SEQ ID NO: 317 - DNA, 3613 bp, Homo sapiens
gtcaggcctctgagcccaagccaagccatcgcatcccctgtgacttgcacgtatatgcccagatggcctgaagtaactgaagaatcacaaaagaagtgaaaaggccctgccccgccttaactgatgacattccaccattgtgatttgttcctgccccaccttaactgagtgattaaccctgtgaatttccttctcctggctaagaaactcccccactgagcaccttgtgacccccgcccctgccccccagagaacaaccccctttgactgtcattttccattaccttcccaaatcctataaaactcagcctataagactcagcccgcctgcacccaggtgaaataaacagccatgttgctcacacaaagcctgtttggtggtctcttcacacggatgcgcatgaaatttggtgcaagaaccccccaccccttctccgtgtctctactcttttctctgggcttgcctccttcactatcggtaagcttccaccttccattcctccttcttctcccttagcctgtgttctcaaaaacttaaaacctcttcaactcacacctgacctaaaacctaaatgccttattttcttctgcaatgccgcttgaccccaatacaaactcgacagtagttccaaatagccagaaaatggcactttgaatttttccatcctgcaaaatctaaataattcttgtcgtaaaacaggcaaacggtctgaggtgcctgacgtccaggcattcttttacacatcagtcccttcctagtctccttgcccagtgcaactcgtcccaaatcttcctttccctctggcctgtcccctcagtaccaaccccaagcgtcgctgagtctttctaatcttccttttctacagacccatctgacctctcccttcctccccaggctgctcctcgccaggccgagctaggtcccaattcttcctcagcctccgttcctccaccctataatctttttatcacctcccctcctcacacctggtccggcttacagtttcgttccatgactagccctcccccacctgcccagcaatttactcttaaaaagccaaaggcatagtcaaggttaatgctcctttttctttatcccaaatcagatagcatttaggctttttcatcaaatataaaaatccagcccagttcatggctcgtttagcagcaatcctgagacactttacagacctagaccctaaaaggtcaaaaggccgtcttattctcaatatacattttattacccaatctgctcccgacattaaataaaactccaaaaattggaatctggccctcaaaccccacaacaggacttaattaacctcaccttcaaggtgtacaataacagaaaaaagttgcaattccttgcctccattgtgagacaaaccccagccacatctccagcacacaagaacttccaaacgcctgaaccgcagcagccaggcgttcctccagaacctcctcccccaggagcttgctacacgtgccggaaatctggccaccaagccaaggaatgcccgcagcccaggattcctcctaagccgtgtcccatctgtgcgggaccccactgaaaatcggactgttcaactcacctggcagccactcccagagcccctggaactctggcccaaggctctctgactgactccttcccagatcttctcggcttagtggctgaagactgacactgcccgatcacctcggaagccccctagaccatcacggacgccgagcttcgggtaactctcacagtgggaagtaagcccatccccttcttaatcaatacggaggctacccattccatattaccttcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggctgagacaatttaactaaattatctgcttccctgactattcctggactacagctatatctcattgccgcccttcttcccaatccaaagcctcctttgcgtcctcctcttgtatccccccaccttaacccacaagtataagatacctctactccctccttggcgaccgatcatgcaccccttaccatctcattaaaacctaatcacccttaccccactcaacgccgatatcccatcccgcagcacgctttaaaaggattaaagcctgttatcactcgcctgctacagcatgggcttttaaagcctataaactctccttacaattcccccattttacctgtcctaaaaccagacaagccttacaagttagttcaggatctgcgccttatcaaccaaattgttttgactatccaccccgtggtgccaaacccatatactctcctatcctcaatacctgcctctataacccattattctgttccagatctcaaatatgctttctttactattcctttgcacccttaatcccagcctctcttcactttcacttggactgaccctgacgcccatcaagctcagcaaattacctagtctgtactgctgcaaagcttcacagacagcccccattacttcagtcaagcccaaatttcatcctcatctgttagtcatactcctattcaccgttctcaactactcatacatgccctgctcttgtttacactgccggtttacactgtttctccaagccatcacagctgatatctcccagtgctatccccaaactgccactctaaactcttgaagtaaataaataatctttgctggcaggactatgctgaatctccttaggcactctctaattagatgccctaggtcctcccaattcttagtccttttatacctgtttttctcctactcttattccatttagtttttcaattcatacaaaaccatatccaggccatcaccaatcattctatacaacaaatgtttcttcttacatccccacaatatcaccccttaccacaagatctcccttcagcttaatctctcccactctaggttcccacaccgcccctaatcccgcttgaaacagccctgagaaacatcgcccattctctctccataccaccccccaaaatttttcgccgccccaacacttcaacactattttgttttatttttcttattaatataagaaggcaggaatgtcaggcctctgagcccaagccaagccatcgcatcccctgtgacttgcacgtatacgcccagatggcctgaagtaactgaagaatcacaaaagaaatgaaaaggccctgccccgccttaactgatgacactccaccattgtgatttgttcctgccccaccttaactgagtgattaaccctgtgaatttccttctcctggctcagaagctcccctactgagcatcttgtgacccccgcccctgccccccagagaacaaccccctttgactgtaattttccattaccttcccaaatcctataaaacggccccatccctatctcccttcgctgactctcttttcggactcagcccgcctgcacccaggtgaaataaacagccatgttgctcacacagagcctatttggtggtctcttcacacggacgtgcatgaaa

SEQ ID NO: 318 - DNA, 983 bp, Homo sapiens
gtagggaaaagaaagagcgatcagactgttactgtgtctatgtagaaagggaagacataagaaactccattttgacctgtaccctgaacaactgctttgccctgggatgctgttaatctgtaactttgccccaaccttgagctcacagaaacatgtgttgtatggaatcaaggtttaagggatctagggatgtgcagaatatgccttgttaacataatgtttacaggctgtatgcttggtaaaagtcattgccattctccagtctcaataaaccaggggcacaatgcactgtggaaagccgcagggacctctgccctggaaagctgggtattgtccaaggtttttccccatgtgatagtctgaagtatggccttgtgggatgggaaagacctgaccatcccccagcccgacacctgtgaagggtctgtgctgaggaggattagtaaaagaggaaagcctcttgcagttgagattgaggaaggcctctatctcctgcctgcccctgggaactgaatgtctcggtataaaacccgattgtacatttgttcaattctgagataggagaaaaaccgccctgtggcgggagtcgagacacgttggcagcaatgctgctttattattttttactccactgagatgtttgggtagagaaaagcataaatctggcctatgtgcacatccaggcatagtaccttcccttaaacttatttgtgacacagatttctttgctcacgtgttttcttgctgaccttctccccactatcaccctgctctcctgccgcattcctcttgctgagatggtggaaatagtaattaataaatactgagggaactcagagaccggtgcctgtgcaggtcctccgtgtgctgagtgctggtcccctgggcccacttttctttctctatactttgtctctgtgtcttatttgttttctcagtctctcatcccacctgacaagaaatacccacaggtgtggaggggc

SEQ ID NO: 319 - DNA, 58 bp, Homo sapiens
tgcctgtatatgccggcagccccctagcccgctctttcactggatatctgtgtctgag

SEQ ID NO: 320 - DNA, 5642 bp, Homo sapiens
gtcaggcctctgagcccaagctaagccatcatatcccctgtgacctgcacgtatacatccagatggcctgaagtaactgaagatccacaaaagaagtgaaaatagccttaactgatgacattccaccattgtgatttgtttctgccccaccctaactgatcaatgtactttgtaatctcctccacccttaagaagattctttgtaattctccccacccttgagaatgtactttgtgagatccaccccctgcccccaaaacattgctcctaactctaccgcctatcccaaaacctgtaagaactaatgataatcccaccaccctttgctgactctctttttggactcagcccgcctgcacccaggtgaaataaacagccttgttgctcacacaaagcctgtttggtggtctcttcacacagacgtgttagacatttggtgccgaagacccgggtcagagggactccttcgggagtcccttgtcctcaccctcacttcgtgaagagatccacctacaatctccggtcctcagaccaaccagtccaaggaacatcgcaccaatttcaaattgggtaagcggtcttttcactctcttctccagcctctctcgctacccttcaatcttcctctcttgctaccctttgatctccctgtccttccaattccagttctttttcctctctagtagagacaaaggagacacattttatccatggacccaaaactccggcgctgatcacggactcaggaagacagccttcccttggtgtttaatcattgcggggatgcctgcctgattattcactcactctccattggtgtctgatcaccgcggggacgcctgccttggtcattcacccacattcccttggtggcaagtcaattgcggggatgcctgctttggctgctcacccacattgcagcccagggctgctccccaccccccttctctgtgtctctacccttctctttaaacttcctccttcactataggcaaacttccaccctccattcctcctttttctcccttagcctgtgttctcaagaacttaaaacctcttcaactcttgcctgacctaaaatttaaacaccttattttcttctgcaataccacttggccccagtacaaactctacagtagttccaagtggccagggaatggcacttttgatttgtctatcctacaagatctacagaatttttgtcgaaaaatgggcaaatggtctgaggtgcctgatgtccaggcattctttacacattggtccctccctagtctctgctcccgatgagactcatcccaaatctttcttctttctctgctgtctgttccttcagtctccaccccaagctctgagtcctttgaatccttattttctatggactcatctgacctctccccttctccctgggctgctcctcgccaggccgagccaggtcccaattcttcctcagcctctgctcccccaccctataatctttctatcacctcctctcctcacacctggtctggtttacagtttcgttctgtgactagctctctccgacctgcccaacaatttcctcttagagaggtggctggagctgaaggcatagtcagggtacatgtgcctttttctccatgagacctttcccaaatcagccggcgtttaggctctttctcatcagaccccactaaatatatacaggaattccgatatccaattctgtcctacaatttaacctggagtgacttaagtgtcaacctaacttctacccgctccccagatgaatgggaaagagttttttctccagcccaatctcatgctgataaccgccagcttcataagccaggcctccaggaaggcattagagcagttcccctagaagatccccagtggaactatcaggcagattccccaggtatagctgggcaagattacatggtttcctgcctagttgaagggcttaaaaaggcagcttacaaacctgttaattctgacaaacttaaagaaactacccaaggtaaagacgaaaacccagcccagttcagggcccgcttagcagcaacacttagacgctttaccgccctagacccagaggggccagaaggccgccttattcttaatatgcattttatcacccagtcagctcctgacgttagaaaaaagcttcaaaaattggaatctggccctcaaaccccacaacaggaattaatcaacctcgccttcaaggtgtacaataatagagaggatagagaggaggtagccagacagcaacgcatttctgagttacagctacttgcctctgctgtaagacaacccacaaccacgtctccagcatacaagaacttcagaacatcaaagccacagctcccaggggctccttcaaaacatcctcgtggaccttgcttcaaatgccaaaagcctggccactgggcctcagtatgcccgcagcctgggattcctcctaagccgtgccctgcctgtgctggcccccactggaggtcggactgcccgactcacatcgctgccgctcctaaagcccctggaacccagacccaacgttctttggccgactcattcccagatctcctcggcttagcagctgaagactgatgccgcctgatcgcctcggaagccccctggaccatcacagacaccgagctttgggtaactcttacagtggagggtaagtccgtcccctctttaattgatatgggggctacccactacacattaccttcttttcaagggcctgtttcccttgcccccataactgttgtgggtattaatggccaagccccaaaaccccttaaaactctccaactctggtgccaacttggacaacattcttttatgcactccttttaattatccccaactgcccagctcccttattaggtcgagacattttaactaaattatctgcttccctgactattcctgggctacagccacacctcattgctgcctttcccccagttcaaagcctccttcacatcctctccttgtatctccccaccttaatccacaagtataggacacctctactccctccttggcgatggatgatggaccccttatcatcccattaaaacttaatcactcttaccccgctcaatgccaatatcccatcccacagcatgcttaggaggattaaagcctgttatcactcacctgctacagcatggccttttaaagcgtataaactctccttacaattcctccattttacctgtccagaaactggacaagtcttacaggttagttcaggatctgcgccttatcaaccaaattgtcttgcctattcaccccatggtgccaaagccatatactctcctatcctcaatacctccctccacagcccattattctgttctagataaacctagctgaccccataaatcctaaatcctttccccactcccctttccattccttaaaaaatagccctaaaggctgctcccacactagctctccctaactcatcccaacctttttcattacacacagccgaagtgcagggctgcatggtcggaattcttacacaagagccgggacggtgccctgtagtctttctgtccaaacaacttgaccttactcttttagcctagccctcatgtctgcgtgtggcggctgccactgctttaataggggccctcaaaatcacaaactatgctcaactatctacaattctcataacttccaaaatctattttcttcctcatacctgacacatataccttctgctccctagatcctttggctagactcactcttttttgagtctcccacaattaccattgttcccggcctggacttcaatccagcctgtcacattattcctgataccacacctgacccccatgactgtatctctcggatacacctggcattcgctccatttccccaaattttcttctttcctgttcctcaccctgatcacacctggtttagtgatggcagttccaccaggcctaatcaccacacaccagcaaaggcaggctattctatagtatcttccacatatatcattgaggctaccactctgcccccctccactacctctcaacaagccaaactcattgccttaactcgagccctcactattgcaaaggactacgcatcaatatttatactgactctaaatatgccttccatatgctgtaccaccatgctgttacatgggcaaaaagaggtttcctcactacacaaaggtcctccatcaataatgcctctttaataaaaactcttctcaaggccgctttacttccaaaaaaacctagagtcattcactgcaagggtcataaaaaggcatcagatcccatcactcagggcagcacttatgctgataaggtagctaaaaaagcagctagcattccaacttctatctctcacggcagtttttctccttctcatcggtcactcccacctactcccccactgaaatttccacctatcaatctcttcccacacaaggcaaatggttcttagaccaaggaaaatacctccttccagcctcacaggcccattctattctgtcatcatttcataacctcttccatgtaaaagttacaagccactagcctgcctcttagaacctctcacttcctttccatcgtggaaatctatccttaaggaaataacttctcagtgttccatctgctattctactactcctcagggattattcaggccccctcccttctctacacatcaagctcggggatttgcccccacccaggactggcaaattgactttactcacatgctccaagtcaggaaactaaaatacctcttggtctgggtagacactttcactggatgggtagaggcctttcccacagggtctgagaaggccactgtggtcattgcttcccttttgtcagacgtaattcctcagtttggccttcccacctctatacagtctgataatggactggcctttattagtcaaatcacccaagcagtttctcaggctcttggtattcagtggaatcttcataccccttatcgtccttaatcttcaggaaaggtagaatggactaatggtcttttaaaaacacacctcaccaagctcagcctccaacttaaaaaaggaggactctgtcaaggatagatcccaaaaactcaccagccaaacaagtaattacactgaaccccgttgggcactctgtaattggatgtcctgggtcctcccaattcttagtcctttaatatctgtttttctccttctcttatttggacctcgtgttttccgtttagtttctcacttcatccaaaaccgtatccaggccatcaccaatcctatacgacgaatgtttcttctaacaaccccacaatatcaccccttaccacaaaatcttccttcagcttaatctcttccactctaggttcccacgctgcccctaatcccactcgaagcagccctgagaaacattgcccattatctctccataccacccccaaaaattttcactgccccaacactttaccactatttcattttatttttcttatgaatataagacaggaatgtcaggcctctgagcccaagctaagccatcatatcccctgtgacctgcatgtatacatccctctggcctgaagtaattgaagatccacaaaagaagtgaaaatagccttaactgatgacattccaccat

SEQ ID NO: 321 - DNA, 5603 bp, Homo sapiens
cctttgctgactctctttttggactcagcccacctacacccaggtgaaataaacagccttgttgctcacacaaagcctgtttggtggtctcttcacacagaagcatgagacatttggtgctgaagacccgggtcagagggactccttcgggagaccagtcccctgtcctcaccctcactccgtgaagagatccacctatgacgtcaggtcctcagaccaaccagcccaaggaatatctcaccaatttcaaatcgggtaaacagtcttttcactctcttctccagcctctctccctacccttcaatctccctgtccttccaagtccagttatttttcctctctaatagagacaaacgagacacattttatccatggacccaaaactctggcgccagtcaccaacttaggaagacagcctacccttggtgtttaatcattgcagggtgtgcctgcttgattattcacccacaccccattggtgtctgatcaccacggggatgcctgccttggtcattcacccacattcccttggtggcaagtcaattgtggggacacctgctttggctgctcacccacattgcagcccaggactgctccccaccccgcttctccgtgtctctacccttctctttaaacttgcctcctttactatgggcaaccttccaccctccatttctccttcttctcccttagcctgtgttctcaagagcttaaaacctcttcacctcttgcctgacctaaaatctaagcatcttattttcttctccaacaccgcttggccccaatacaaactcgacaatggttctaaatggccagaaaatgacactttcgatttctccatcccacgagacctagatactttttgtcgaaaaaagggcaaatggtctgaggtgccttacgtccaggcatttttcacactttgttccctccttagtctctgttcccaatgcgactcatcccaaatcctccttctttccctcccgcctgtcccttcagtctcaaccccagtcgtcactgagtcttgtgaatcttccttttctgctgacccatctgacccctcacctcctccccagactgctcctcctcagctcgctccccgccaggctgaatcaggctccaactcttcttcagcctctgctccctcaccctataacccttctattaactccccttcccacacccggtctggtttacagtttcattctgcgactagctctccccctcctgcccaacaatttcctcttagagaggtggctggagctgaaggcatagtcagagtacatgtgcctttttctctaccaaacgtttcccaaatcagccagcgtttaggctctttctcatcagacaccaataaatatatacaggaattccaatatctaactctgtcctacagtttaacctggagagacttaaatgtcagcctaacttctaccctctccccagatgaatgggaaagagtcttctctctagcccaatctcacgctgataatcaccggcttcatgagccagacctccaggaaggcattagagcagttccctgagaagatcccctatggaactatcaggcagattccccaggtatagctaggcgaaattacatggtttcttgcctagttgaagggcttaaaaaggcagctcacaaagctgttaattatgacaaacttaaagaaactacccaaggtaaagatgaaaacccagcccagttcatggcctgcttagttagcagaaatccttagatgctttaccgccctagacccagagggaccagaaggtcaccttattcttaatatgcattttatcacccagtcagctcctgacattagaaaaaagcttcaaaaattggaatccggccttcaaaccccacaacaggaattaatcaacctcgccttcaaggtgtacaataatagagaggaggtggccagacagcaacgcatttctgagttacagctacttgcctccgctgtaagacaacccacaaccacatctccagcatacaaaaaaacttcagaacatccaagccacagctcccagaggctccttaaaaacatcctcgtggaccttgtttcaaatgccaaaagcctggccactgggcctcagaatgcccacggcccgggattcctcctgagccgtgccctgtctgtgcaggcccccactggaggtcagactgtccgactcacattgctgctgctcctgaagcccctggagcccaaacccaatgttccctggccaactccttccagatctgatgctgccggatcacctcggaagcctcctggaccatcacagatgctttgggtaactctcacagtggagggtaagtacatccccttattaatcaatacggaggcaacccactccacattaccttcttttcaagggtgtgtttcccttgcctccataactgttgtggattatgacagccaggcttcttaacctcttaaaactccccaactctggtgccaacttggacaattttcttttatgcactcctttttagttatcctcacctgcccagctcccttattggctcgagacattttaactaaattacatgcttccctgactattcctaggctacagccatacctcattaccgcccttttcccccagttcaaagcctccttcacatcctctccttgtatctccccaccttaatccacctctactccctccttgaggatggatgatgcaccccttaccatcccattaaaacctaatcacccttaccccgatcaatgccagtatcccatcccaccgcatgctttaaaaggattaaagcctgttatcacttatctgttgtagcatggccttttaaagcctataaactctccttacaattcccccattttacctgtccaaaaactggacaagccttacattttagttcaggatctgcgccttatcaacaaaattgtcttgcctatccaccccatggtgccaaacccatatattctcctatcctcaatacctccctccacaacccattattctgttctagataaacctagctgaccccataaatcctaaatcctttccacactcccctgtccattccttaaaaaacagccctggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaaaaaaaaacagccctaaaatctgctcccacactagttctccctaactcatcccaacctttttcattacacacagccgaagtgcagggctatgtggttggaattcttacacaagagccaggaccacgccctgtagcctttctgtccaaataacttgaccttactgttttagcctagccctcatgtctgcgtggggtggctgccactgccttaatacttttagagaccctcaaaatcacaaactatgctcaactcactctctacagttctcataacttccaaaatctattttcttcctcacacctgatgcatatactttctgccctcctccactacctctcagcaagccaaactcattgccttaactcgagccctcactcttgcaaaaggactacgtatcaatatttatactgactctaaatatgccttccatatcctacaccaccatgctgttttatgggctgaaagaggtttcctcactactcgagggtcctccatcattaatgcctctttaataaaaactcttcttaaggccgctttacttccaaaggaagctggagtcattcactgcaagggccattaaaaggcatcacatcccatcgctcagggcaacgtttatactgataaggtagctaaagaagcagctagccttccaacttctgtccctcacggccagtttttctccttctcattggtcactcccacctactcaccgactgaaacttctacctatcaacctcttcccacacaaggcaaatggttcttggaccaaggaaaatatctccttccagcctcacaggcccattctaatctatcatcatttcataacttcttccatgtaggttacaagctgctagcccgcctcttagaacctctcatttcctttccatcatggaaatctatccttaaggaaatcacttctcagtgttccatctgctattctactactcctcagggattgttcaggccccctctcttccctacacatcaagctcggggatttgcccctgcccaggactgggaaattgactttactcacatgccccgagtcagaaaactaaaatacctcttggtctgggtagacactttcactagatgggtagaggcctttcccacagggtctgagaaggccaccacagtcatttcttcccttttgtcagacgtaattcctcagtttggccttcccacctatatacagtccaataacgggcctgcctttattagtcaaatcacccaagcagtttctcaggctcttggtatttagtggctcctggttttacctcaaatcgccacccttaagcctctcttgaattggatagaagatcttcagtggcaaggtaccctccaatactttcaccctgatgaagtcctattctttatttttatactcactcttattctggttcccgttcttatgccaccttctacctctccgcagctatctccaccacactatcaaattcactctctcctagccgtttctaatccttctttaacaaacaattgctggctttgcatttcactttcctccaaaatcgctgaggccctgacttactcactgctaaaaaaaagggggggactgtatatttgtaaatgaagagtgttgtttttacctaaatcaatctggcctggtatatgacaacataaaaaaaactcaaggatagagcccaaaaacttgccaaccaagaaaataattatgctgaaccccctttgacactctgtaattggacgtcctgggtgctcccaattcttagtcctttaatacctgtttttctctttctcttatttggaccttgtgtctttcgtttagtttctcaattcatacaaaaccacatccaggccatcaccaataattctatactacaaatgctccttctaacaaccccacaatatcaccccttaccccaaaacctttcttcagttgggtctctcccactgtaggttcccacgccaccccaatcccgcttgaagcagccctgagaaatcacccattatctctccataccaccccaaaaaattttcaccgccccaacactttaccactatttcattttatttttcttattaatataagaagacaggaatgtcaggcctctgagcccaggctaagccatcataacccctgtggcctgcatgcatacatccagatggcctgaagcaactgaagatccacaaaagaagtgaaaatagccttaactgataacattccaccat

SEQ ID NO: 322 - DNA, 5214 bp, Homo sapiens
cccctttgggtcccctcccattgtatgggagctctgttttcactctattaaatcttgcaactgcacactcttctggttcgtatttgttatggctcgagctgagctttcacttgccgtccaccactgtttgctgccatcacagacccgctgttgacttccaccactccagatccagcagggtgtccgctgtgcccctgatccagtgaggcatccattgccactcccaatcaggctaaagtctcgccattgttcctgcgcagctaagtgcccaggttcgtcctaatagagctgaacactagtcgctgggttccacggttctcttccgtgacccacggcttctaatagagttataacactcaccgcatggcccaaggttccattccttggaatccatgaggccaagaaccccaggtcagagaacaaaaggtttgctgccatcttgggagtggctcaccaccatcttgggagtggcccaccaccatcttgggagttctatgaacaaagatccacccgtaatattcggtggcccgtacggggattcttcaaagcggtgagtaataatttgctcgccattctgtcctatccttccttagaattggaggaaaataccaggcacctgtcagccagttaaaaacaattagcatggccactggacttaagactcaggtgtgaggcttcctgggaaaaggctttctaacaagccccaacccttctgggttgggagcattggtctacctagaaccagcttttgctttcacaattttcctggggaagctgagggttgactagaggcagaaagctgttgtcccaaacccccagcattggatggtcgagattatggtgcagccagaagtctctactcaacagtcgcccatgcgtgtgcccctacctctccttctgacccatacctcctgggtcccaaccacaactttcttgaaagtgtagccccaaaattcttcttacttctgaatctacttcctctgatccctgcctcctagatactaatgcttcagactttcacttcctctcccaagtattagagcaagttgtatctctaaagggatctaaggaagctctacgctgtgtccttgggcacctaggctatgaatccagggagttttatccctggtgttcctcccaatttaggcatgcagctctcgacatgggcagttatgtgggacccgttccccaccacccttgccagggccttagaactgataacccagtactttaacaactggaactgggtctacaacataatatatcaagatgaaaatgaattgagtaaattaaagggaggcacatattcctatagcggcaaatgggggcaacaagtgaacgaccctccactgtgtttccaaaatccacctacagagacagagaggagagagacagagagagacagagaggtgggggtggtgggtaagagaggcagagagagaaagaaagagaaagacagaagtagtaaagaaaaaacagtgtgccctattcctttaaaagccagagtaaatttaaaacctataattgataattgaaggtcttctctgtgaccctataacactcgatactaccttgttgtcagtgtaaacaagggcgtagcctgaaaacactgagaccactaacaactcgtagccttcctatcaaaaatctttaacccagtaacctgcggatggcccaaatgcattcaatctgtagtggcaactgttttgctaacagaagaaagtagaaaaataacttttagagaaaacctcattgtgaacacacctcaccagttcagaactatcctaagtcaaaaaaaaaaaaaaaaaaacaaagccaaaaggtagcttactaactcaaaaatcttaaagtgtaggactattctgttagaaaaagatgatttaacattaaccactgaaatttcccttaacccagcagatttcctaaaaagggatttaaatcttaattaccatacgaaggtcccaccagacctaggaggaactcccttcagaacaggacaatagatggttcctcccaggtgatggagaaaaaaaaccacaatgggtattcagtaattgatagggaaactcttgtagaagcagagttagaaaaattgcctaataattggtctgctcaaacgtatgagccctttgcactcagccaagccttaaagtacttacagaatcaaaaaactccatctcaatcctgactcaaaggttacctacaccctctctgaaatgaatttgcataagaactgttgtttatgggaatgcatcttgatggggcaactgggttgttatgaaatactcaggaacccagcctagctctaggactcacccctgagcacaaaggcaatgttgggcacactggtaaaggaccactagaatccagcagcctggacccctttctttgtggtcaagaaaggcgggaaaaggggtgcaggactgctacatcagtgaatgttaactaatccgataagcagatgtccatgggtggttatgcaccctggaaaggaataagcattaggaccatagaggacgctgtaggactaaggctcatcagaaaatgactaggggtgctggcatccctatgttcttttttcagatgggaaatgttccccccaaggcaaaaaagctcctaagatatattctggagaatttggcccagtcagagtgcacgtaactctttccctctcagacttgaaacaaattaaaatagacctaggtaaattctcagataaccctgatggctacattgatgttttacaagggttaggacaatcctttgatctgtcatggagagatataatgttactgctagatcagacactaaccccaaatgagagaagtgccaccataactgcagcccaagagtttggcaatctctggtatctcagtcaggtcaatgataggatgacaacagaggaaagggaatgattccccacaggccaggaggcagttcccagtgtagactctcactgggacgctgaattagaacatggaaattggtgccacagacatttgctaacttgcatgctagaaggactaaggaaaactaggaaggagcctataaatcattcaatgatgtccactataacacagggaaaggaagaaaatcttactgcttttctggagagactaagggaggcattgaggaagcatatctctccgtcacctgactctactgaaggccaactaatcttaaaggataagttatcactcagtcagttgcacacattagaaaaaatttcaaaagtctgccttaggcctggagcaaaacttagaaaccctattggcaacctcgatttttttataatagagatcaggaaaagcaggtgaaatgggaaaactgggataaaacaaaaaaggccacccactgctttagtcgtggccctcaggcaagtagactttggaggctctgaaaaagggaaagcctgggcaaactgaatgcctaatagggcttgcttccagtgcggtctacaaggacactttcaaaaagattgtccgaatagaaataagccaccccctcgtccatgccccttatgtcaagggaatcactggaaggcccactgccccaggggatgaaggtcctctgagtcagaagccactaaccagatgatccagcagcaggactgagggtttccagggcaagtgccagcccatgccatcaccctcacagaggcccgggtatgcttgaccattgagggccagggcgttaactgtctcctggacactggcgtgaacttctcagtcttactctcctgtcctggacaactgtcctccagatctgtcactatctgaggggtcctaggacagccagtcactagatacttctcccagccactaagttgtgactggggaactttactcttttcacatgcctttctaattatgcctgaaagctccacttctttgttagggagagacatcctagcaaaagcaggggtcattataccctagaattaggagaaggaaaaagggtaaatatatatacagactctaagtatgcttacctagtcctccatgcccacgcagcaataaggagagaaagggaattcctaacttccaagggaacacctatcaaacatcaggaagccattaggagattattattggcagtacagaaacctaaagaggtggcagtcttacactgccggggtcatcagaaaggaaaggaaagggaaatagaagggaactgccaagcagatactgaagcaaaaagagccgcaagacaggaccctccattagaaaagcttatagaaggacccctagtatggggtaatcccctccaggaaaccaagccccagtactcagcagaagaaatcgaatggggaaactcacaaggacatcgacatcgtttcctcccctcaggatggctagccaccgaaaaaggaaaaatacttctgcctgcagctaaccaatggaaattacttaaaacccttcaccaaaccttttacttaggcattgatagcacccatcagattgccacatcattatttactgaaccaggccttttcaaaactataaagcagatagtcagggcctgtgaagtgtgccaaagaaataatcccctgcacttcaggccatacatttcaatccctgtatctttaacctccttgttaagtttgtctcttccagaatcgaagctgtaaaactgcaaacagttcttcaaatggacccccagatgcagtccatgactaagacctaccacggacccctggaccggcttgctagcccatgctctgatgttaatgacatcgaagccaccctttccaaggaaatctcaactgcacaacccctactatgccccaattcagcaggaagcagttaagagtggttgtcggccaaccttgccaacagcacttgggctttcctgttgacggggggactgagagacaggactagctggatttcctaggccgattaagaattcctaagcctagctgggaaaggtgaccgcacctacctttaaacacagggcttgtaactcagctcacacccaaccaatcaggtagtaaagagggctcgctaaaatacaaattaggctagagcagaaggtaaagacacagtcaaatcatatatcgcctgagggcacagggggagggacaatgattgggatataaactccaggcattcgagccgggagtgggcaacctcctttcaggggcaaccccctttgggtcccctcccattgtatgggagctctgttttcactctattaaatcttgcaactgca

SEQ ID NO: 323 - DNA, 435 bp, Homo sapiens
gtcaggcctctgagcccaagctaagccatcatatcctcagtaacctgcacttatacatccagatggcctgaagcaactgaagatctacaaaagaagtgaaaatagccttaactgatcacattccaccactgtgatttgtttctgccccacgctaactgatcaatgtacttggtaatctcccccccacccttaagaaggttctttataatctccccacccttgagaatgtactttgtgagatccaccccctgcccccaaaacattgctcttaactccaatgcctatcccaaaacctataagaactaatgataattccaccaccctttgctgactcctttttttcagactcagcctgtctgcacccaggtgaaataaacagccttgttgctcagacaaagcctgtttggtggtctcttcacatggacacacgtgaga

SEQ ID NO: 324 - DNA, 695 bp, Homo sapiens
tcagaataggtagctaggcagacatgagcagggcaggagagatcccccacccccaacccaggaatattaggtgaccgtcaggtaatagtcaggcagttgttaaccgtctctctaaaataataattggtcgcagctggtgccagggaacggcagtctcccaatagatagaaaatacttgaagctgatgatcaacagcttcctgatatgatctcaggagttgggcaactggggtcaaacatgcgcaataagaggcaaaataatggagtttaactggtatatgaccttcctctaagaatactcgactggtaaaagaaaaatgcctcaaatgagcatgcgcacaacctaagtaaacacactgtgcgtgcggcccctcccaagtgctggcaggctactgctcatgcagacagcccaccccaagggaagaatcaggggagaaaagatgcaaactttggaattatgccaatgtatgaaaccctaagtcaagggccaagtagggcagttggatctctcaagttgccctcttggccctcttccaagtgtgctttacttcctttccttcctgctctaaaactttttaataaactctcactcctgctcaaaaacttgcctcagtctctctctctgccttatgcccctcagatgaatcctttcctttgaggaggcaagaattgagttgctgcagacctttacggatt

SEQ ID NO: 325 - DNA, 4659 bp, Homo sapiens
ccacaaaagaagtgaaaatggctggttcctgccttaacggatgacattaccttgtgacattccttctcctggacaataagtctccgtagctccccaccaagcaccttgtgacccctgcccctgcccgccagagaacaaccccctttaactgtaattttccactacctacccaaatcctataaaactgcccaccccatctcctttttcagactcagtccacctgcacccaggtgattaaaaagctttattgctcacacaaagcctgtttggttcacatggacgtgcatgatatttggtgctgaagacccgggacaggaggactccttcaggagaccggtcccctgtccttgccctcattccatgaggagatccacctatgacctccgatcctcagatcaaacagcccaaggaacatctcaccaatttcaaattgagtaaacggtcttttcactctcttcttcagcctctctcactacccttcaatctccctgtccttccaattcgggttcctttttctctctagtagagacaaaggagacacattttatccatggacccaaaactgcagcaccggtcatggactcaggaagacagtcttcccttggtgtttaatcactgcagggatgcctgccctgatcattcacccacattccattggtgtctgatcaccggggggacacctgccttggtcattcacccacattcccttggtggcatgtcaattgcagggacacctgctttggctgctcacccatattacagcccagggctgctcaccgcccgcttctccgtgtctctagctttctctttaaacttacctcttcactgtggtcaaccttccaccctgcattcccccttcttctcccttagcctgtgttctcaagaacttaaaacctcttcaactcacacctgaactaaaacctaaatgccttattttcttctgcaatactgctaggccccagtacaaactcgacaattgttctaaatggccagaaaacagcacttttgatttctccatcttacaagacctggatgattttttgtcaaaaaatgggcaaatggtctgaggtgcctgatgtccaggcattctttcacacattggtccctccctagtctctgctcccaaagcgactcatcccaaatctttttttttctctcctgtctgtttccttccatctccaccccaagctctgagtcctttgaatccttcttttctacggactcatctgacctctcccctcctccctgacgctgctcctcgccaggctgagccaggtcccaattcttcctcagcatctgctcccctaccctataatccttctatcacctcccctgctcacacccagtctggcttacagtttcgttctgcaactagccctcctcacctgcccaaaaatttcctcttaaaaaggtggcttgagctgaaggcacagtcaaggttaatgctcctttttctttatctgacctctcccagatcagttagcatttaggctctttttcatcaaatataaaaacccagccccgttcatggcccacttagcagctaccattagatgcttcacagccctagacccagaggggccagaaggccaccttatccttaatatgtattttattacccaatctgctcccaacattagaaaaagctccaaaaatgagattccggccctcaaaccccacaacaggacttaatgaaccttgccttcaaggtgtacaataatagagaagaggcagccaagtggcaacatatttctgagttgcaattactcgcctctgctgtaagagaaaccccagccacatccagcacacaagaacttcaaaacgcctaagccgcagcagacagttgttcctccaggacctcctcccacaggatcttgcttcaagtgctggaaatctggccactgggccaagaaatgtccacagcctgggattcctcctaagccgtgtcccatctttgcgggaccccactggaaatccaactgtcccactcgcccaccaaccacacccagagcccctggaaatctggcccaaggctgtctgactgactccttcccagatcttctcttcttagctgctgaagactgacactgcctgattgcctcagaagcctcctggaccatcacagatgctttaggtaactcttacagtggagggtaagtctgtcccctttttaatcaatacagaggctacccactccacattacctacttttcaagggcctgtttcccttgcctccataactgttgcgggtattgacggccaggctgctagactccttaaaactccccagctttggtgccaactgggacaaaattttttttttttttgagatggagtctctctctattgcccaggctggagtgcagtggcgcgatctcggctcactgcaagctccatctcccaggttcatgccattctcctgcctcagcctcccgagtagctgggactacaggtgcctgccaccacgcctagctaatttttttgtattttttttttagtagagacggggtttcaccgtgttagccaggatattctcgatttcctgacctcgtgatttgcccgcctcggcctcccaaagtgctgggattacaggcatgaaccaccgcccccggcctgggacaacattcttttatgcactcttttttaattatccccacctgcccagtacccttattaggccaagacattttaacccggacaagtcttacaggctggtccaagatcttcgccttatcaaccaaattgtcttgcctatccaccctgtggtgccaaacccatatactctcctatcctcaatacgcccctccacaacccattaatctgttctggatctcaaagatgctttctttactattcctttgcatccttcatcccagcctctcttcggtttcacttggactgaccctgacacccatcagcctcagcaacttacctgggctgtactgccacaaggcttcagggacagcccctattacttcagtcaagccctttctcatgatttactttctttccatcactcccacctactctcccactgaaacttccacctatcaatctcttcccacacaaggcaaatggttcttggactaaggaaaattcctccttccagcctcacaggcccattccattctatcgtcctttcataacctcttctatgtgggttacaagccaccagcccacctcttaaaacctctcatttcctttaagacatttaccttgtatttcactccatccttggctaccttccccttgctcttcagactctcctcccaggccctcttcttgtttgcttatacccagccctgtaaataacagtgaatggttgcttgtagatactcgacgttttttcatgcaccatgaaaattgaacctcctcctctaggaagttaccccatcagtctccattacaacctctgacggctgccaccctagctggatccctaggagtctgggtacaagaaacctttagtactccttctcatctttttactttgcatttccagttttgcctcgcacaaggtctcttcttcctctgtggatcctctacctacatgtgtctacctgctaattggacaggcacatgcacacaagttttccttactcccaaaattcaatttgcaaatgagaccgaagagttccctgttcccctcatgacaccaacagttcactactattttgttttgtttttcttattattaatataaaaagacaggaataggccttgacttactcactgctgaaaaaggaggactctgaatatttccaaatgaagaaggttgttttcacctaaatcaatctggcctggtatatgacaacataaaaaaactcaaggacagagcccaaaaacttgccagtcaagcaaataattacactgaacccccttggacactctctaattggatgtcctaggtcctctcaattcttggtcctttaatacctgtttttctccttctcttattcggaccttgtgacttccatttagtttctcaattcacacaaaactgcatccaggccatcaccaatcattctatacgacaaatgctccttctaacaaccccacaatgtcaccctttaccccaaaatctttcttcagtttactctctcccactctaggttccgacattgctcctaatcctgctcgaagaagccctgagaaacatcacccattatctctccataccacctccaaaaattttcgccaccccaacacttcacctctattttgttttgtcccaacacttcaccactattttgttttgtttttcttattaatataagaagacaggaatgtcaggcctctgagcccaagcctgcacgtgtacatccagatggcctgatgcaactggagaaccacaaaagaagtgaaaatggctggttcctgccttaactgatgacattaccttgtgacattccttctcctggacaatgagtctcagaagctcccccactgagcaccttgtgacccctgcccctgcccacaagagaacaaccccctttaacgtaattttccattacctacccaaatcctataaaactgccccaccccatctccctttgctgactcctttttcggactcagtccacctgcactcaggtgattaaaaagctttattgctcacacaaagcctgtttggtggtctcttcacacggacgcacgtga

SEQ ID NO: 326 - DNA, 974 bp, Homo sapiens
gtggggaaaagaaagagagatcagactgttactgtgtctatgtagaaagaagtagacataagagactccattttgttctgtactaagaaaaattcttctgccttgagatgctgttaatctgtaaccctacccccaaccctgtgctggcagagacatgcactgtgttgactcaaggtttaatggatttagggctatgcaggatgtgctttgttaaacaagtgcttgaaggcagtttgcttgttaaaagtcatcaccactctctaatctcaagtacccagggacacaatacactacacactacggaaggctgcagggacctctgcctaggaaagccaggtattgtccaaggtttctccccaagtgatagtctgagatatggccttgtgggaagggaaagacctgaccatcccccagccagacacccataaagggtctgtgctgaggaggattagtaaaagaggaaggcctctttgcagttgagataagaggaaggcatctgtctcctgctcgtccctgggcaatggaatgtctcggtgtaaaaccggattgtatgttccatcaactgagataaggagaaaactgccttaaggctggaggtgagacatgctggctgcaatactgccctttaatgcaccgagatgtttatgtatgtgcacctcaaagcacagcaccttttctaaccttgtttatggcacacagacatttgttcacatgttttcctgctgaccctctccccactattaccctattgccctgccacatccccctctctgagatggtagagataatgatcaataaatactgagggaactcagagactggtgccagcgtggatcctccatatgctgagtgccggtaccctgggcccatgtttctttctctatactttgtctctgtgtctctttcttttctcagtctctcatcccacccaatgagaaaaacccacaggtgtggaggggcaggtcaccccttca

SEQ ID NO: 327 - DNA, 5920 bp, Homo sapiens
gtcaggcctctgagcccaagccaagccatcgcatccccctgtgacttgcacgtatatgcgcccagatggcctgaagtaactgaagaatcacaaaagaagtgaatatgccctgccccaccttaactgatgacattccaccacaaaagaagtgtaaatggctggtccttgccttaagtgatgacattaccttgtgaaagtccttttcctggctcatcctggctcaaaaaccaccctcactgagcaccttgcgacccccactcctgcctgccagagaacaaaccccctttgactgtaattttcctttacctaccctaatcctataaaacagccccacccttatctcccttcgctgactctctttttggactcagcccgcctgcgcccaggtgaaataaacagccatgttgctcacacaaagcctgtttggtggtctcttcacacggacacgcatgaaatttggtgccgttttttgttgctcacacaaagcctgtttggtgtctcttcacacagatgcgcatgaaatttggtgctgtgactcggatcaggggacctcccttgggagatcagtcccctgtactcctgttctttgctctgtgagaaagatccacttatgacctcaggtcctcagaccaaccagcccaaggaacatctcacatattttaaatcaggtaagcggcctcttcttactctcttctccaacctctctcactgtccctcaaccactttctcctttccactcttcaatctctcccttctcttaatttcaattcctttcattttctgggagagacaaaggagacgcattttatctgtggacccaaaactccggcactggtcacagactgggaaggcagccttcccttggtgtttaatcattgcagggacgcctctctgattatacacccacgtttcaagggtgtcaaaccacgcagggacgcctgccttggtccttcacccttagcggcaagtcccgcttttctggggaaggggcaagtacctcaaccccttctctccatgtctctaccccttctctgcttttctgggagaggggcaagtacccctcaaccccttctccttcacacttagcagcaagtcccgcttttctatggggcaagaacccctaatcccttatttccatgccgcaacctcttatctctgcgccccaatcccttatttccgtgccccaacctcttatctctgcgccccaatcccttatttctgcaccccgacctcttatctctgtgccccaatcccttatttccgcgccccaacctcttatatctctgcaccccaatcccttatttccacaccccgacctcttatctctgcgacccaacccattttcccacttttctggaaggtaagaacccccgaaccccttccctccatttctctactctctcttttctctaggcttgcttccttcactataggcaaccttccaccctccattcctccttctactcccttggcctgtgttctcaaaaacttaaaacttcttcaactcacgcctgacctaaaacctaaatgccttattttcttctgcaatgctgcttgaccccaatacaaactcgatagtagttccaaatagccagaaaatggcacttggaatttttccatcctgcaagatctaaataattcttgtcgtaaaataggcaaatgttctgaggtgcctgacatccaggcattcttttacacatcagtcccttcctagtctctgtgcccagtgcaactcctcccaaatcttccttctttccctcccgcctgtcccctcagtcccaaccccaagcgtcactgagtctttcaaatcttccttttctacagacccatccgacctctcccctcctcaccaggccgagctaggtcccaattcttcctcagcctccgctcctccaccctataatccttttatcacctcccctcctcacacccggtctggcttacagtttcattctgtgactagccctcccccacctgcccagcaatttattcttaaaaaggtggctggagctgaaggcatagtcaaggttaatgctcctttttctttatcccaaatcagatagcgtttaggctctttttcatcaaatataaaaatccagcccagttcatggctcgtttggcagcaaccctgagacactttacagccctggaccctaaaatgtcaaaagccatcttattctcaatatacattttattacccaatctgctcccaacattaaataaaactccaaaaattaaattccagccctcaaaccccacaacaggatttaattaatctcgccttcaaggtgtacaataatagaaaaaagtttcaattccttgcctcctctgtgagacaaatcccagccacatctccagcacacaagaacttccaaacgcctgaaccgcagctgccaggcattcctccagaacctcctcccacaggagcttgctacaagtgccagaaatctgacccccaggccaaggaatgcctgcagcccaggattcctcctaagccgcgtcccatctgtgtgggaccccactgaaaatcggactgtccaactcacctggcagccactcccagagcccctggaattctggcccaaggctctctgactgactccttcccagatcttctcggcttagttgctgaagactgacactgcccaatcgcctcggaagccccctagaccatcaaggatgcctagcttccagtaactctcacagtggaaggtaagcccgtccccttcttaatcaatacggaggctacccactccacattaccttcttttcaagggcctgtttcccttgcctccataactgttgtgggtattgacggccaggcttctaaacctcttaaaactcctcaactctggtgccaacttagacaatactcttttaagcactcctttttagttatcctcacctgcccagttcccttattaggctgagacactttaactaaattatctgcttccctgactcttcctggactacagctatatctcattgctgcccttcttcccaatccaaagcctcctttgcatcctcctcttgtatccccccaccttaacccacaagtataagatacttctactccctccttggcgaccgatcatgcaccccttaccatctcattaaaacctaatcacccttaccccactcaacgccaatatcccatcccgcagcacgctttaaaaagattaaagcctgttatcactcgcctgctacagcatggccttttaaagcctataaactctccttataattcccccattttacttgtcctaaaaccagacaagccttacaagctagttcaggatctgcaccttatcaaccaaattgttttgcctatcccacctttggcaccctgtggtgccaaacccatatactctcctatcctcaatacctgcctctataatccattattctgttctagatctcaaacatgctttctttactattcctttgcacccttaatcccagcctctcctcactttcacttggactgaccctgacacccatcaagctcagcaaattacctaggctatactgctgcaaagcttcacagacagcccccattacttcaatcaagtccaaatttcttcctcatctgttacctatctcggcataattctcataaaaacacacgtgctctccctgccaatcgtgtccaactgatctctcaaaccccagcaccttctacaaaacaactcctttccttcctaggcatggttagcgtggtcagaattcttacacaagagccaggaccacaccctgtagcctttctgtccaaacaacttgaccttactgttttagcctagccctcatgtctgcgtgcagtggctgccgctgcattaatacttttagaggccctcaaaatcacaaactatgctcaactcactctgtacagttctcataacttccaaaatctattttcttcctcatacctgacgcatatactttctgcttcccggctccttcagctgtactcactctttgttgagtctcccacaattaccgatgttcctggcccagacttcaatccggcctcccacattattcctgataccacacctgacccccatgactgtatctctctgatccacctgacattcaccccatttccccagatttccttctttcctgttcctcaccgtgatcacgcttgatttattgatggcggttccaccaggcctaatcgccacacaccagcaaaggcaggttatgctatagtacaagccactagcccgcctcttagaacctctcatttcctttccatcgtggaaatctatcctcaaggaaataacttctcagtgttccatctgctattctactactcctcagggattcttcaggccccctcccttccctacacatcaagctcgaggatttgccccacccaggactggcaaattagctttactcaacatgccccaagtaagataactaaaatacctcttagtctgggtagatactttcactggataggtagaggcctttcctacagggtctgagaaggccactccagtcatttcttcccttctgtcagacataattcctcagtttagccttcccacctcaatacagtctgataacagacgagcctttattagtcaaatcagccaagcagtatttcaggctcttagtattcagtgaaacctttatatcccttacggtcctccgtcttcaagaaaagtagaatagactaaaggtcttttaaaaacacacctcaccaagctcagccaccaacttaaaaaggactggacaatacttttaccactttcccttctcagaattcaggcctgtcctcggaatgctacggggtacagcccatttgagctcctgtatagacgctcctttttattaggtcccagtctcattccagacaccagaccaacttggacggtgctccaaaaaaattgtcatccctactatcttctgtctagtcatactcctagtcaccgttctcaactactcatacgtgccctgctcttgtttacactgccggtttacactgtttttccaagccgtcacagctgatatctcctggtgctatccccaaactgccactcttaactcttgaagtaaataaataatctttgctggcaggactatgctgaatctccttaggcactctctaatcagatatcctgagtcgtcccaattcttagaccttttatacctgtttttctccttctcttattccagtttctcaattcatccaaaaccgtatccaggccatcgccaatcattctatacgacaaacatttcttctaacatccccacaatatcaccccttaccacaagacctcccttcagcttaatctctcccactctaggttcccacgccgcccctaatcccgcttgaagcagccctgagaaacatcgcccactctctctccataccaccccccaaaaattttcgccgccccaacacttcaacactattttgttttatttttcttattaatataagaaggcaggaatgtcaggcctctgagcccaagccaagccatcgcatcccctgtgacttgcacgtatacgcccagatggcctgaagtaactgaagaatcacaaaagaagtgaaaatgccctgccccgccttaactgatgacattccaccacaaaagaagtgtaaatggccggtccttgccttaagtgatgacgttaccttgtgaaagtccttttcctggctcatcctggctcaaaaaccacccccactgagcaccttgcgacccccactcctgcctgccagagaacaaaccccctttgactgtaattttccattaccttcccaaatcctataaaacggcccacccttatctcccttcactgactctcttttcggactcagcccgcctgcgcccaggtgaaataaacagccatgttgctcacacaaagcctgtttggtggtctcttcacacggacgcgcatgaaa

SEQ ID NO: 328 - DNA, 576 bp, Homo sapiens
tatagtaggtagctaattagatatgaacaaggcaatagaaaaaccccctcccactgccccttccacaaacagaaatgtcaggtgacgatcaggtgatggtcaagtggttgttaactgtctatctaaaataataattgttcgcagctggcaccagggaaaggtaacccccccgaaaagatagggaaaatccaaagctggtgatcagtagtttcccagtaagatttcaggagttgggtgagtgggctcacctatgcacactaagaggcaaaatggcggaatttaactgataaataaattcctagagacattcggctggtaagggaagaacacctcaagtgagtttgtgtacaattccagtaaacactctgtgcatgcttccctcccaagtgctagcagaggccactgcacatgtgaacagcccaccccaagggaagaatcggggggaagaaacacaaaatggcggaagtatgccaatgtataaaaccccaaatcaaaaggtcaaactgtgatcttgatctctcaaattgcctgcctgctcctcttccacgtgtactttattttcttttcattcctgct

SEQ ID NO: 329 - DNA, 5493 bp, Homo sapiens
tgactctcttttcggactcagcccacctgcacccaggtgaaataaacagccttgttgctcacacaaagcctgtttggtggtctcttcacacagatgcaagtgaaattttggtgctgtgactcggatcaggggcctcccttggaatatcaatcccctgtcctcctgctctttgttccgtgagaaagatccacctacgatctctggtcctcagaccaaccagcccaaggaacatctcaccaattttaaatccggtaagtggcctctttactctcttctccaacctctctatccctcaacctctttctcctttcaatcttggcaccacacttcaatctctcccgtctcttaatttcagttcctttcattttctggtagagacgaaggagacaccttatatccatggacccaaaactccggcgccagtcacagactcgggaagacagtctccccttggtgcttaatcacgcggggatgcctgcctgattattcacccatgtttcagaggtgtctgaccacgtggggacgcctgccttggtccttcacccttagcagcaagtaccgcttttctggggggcaagaaccccctgaccccttatctctgtgtctctaccacttctctgcttttctggagggcaagaaccccccaaccccttctctccatgtctctaccctttctccgcttttctgggaggcaagaaccccctgaccccttctctccatgtctctaccccttctccgttttttgggggtcaagaaccccccaccccttctctctgtgtctctactctcttttctctgggcttgcctccttcactatgggcagccttccatcctccattcctccttcttctcccttagcctgtgttctcaagaacttaaaacctcttcaactcacacctgacctaaacataaatgccttattttcttctatgatgccgtttgaccccattacaacctcgatagtggttccaaatagtcagaaaacagcacttttgatttttccatcctacaagatctagataattcttatcgtaaaataggcaaatggtctgaggtgcctgacatccaggcattcttttacacattgttccctccctagtctctgttcccaatgtgactcttcccaaatcctccttctttccctcccatctgtcctcccagtcccaaccccaagcgttgctgagtctttctaatcttccttttctacagacccatctgactttcccccttctccccaggctgctcctcgccaggccaagccaggtcccaattcttcctcagcctctgctccccccaccctataatccttttatcacctcccctcctcacaccctgtccagcttacagtctcattccacagctagccctcccccacctgcccagcaatttcctcttaaaaaggtggctggagctagtggcatagtcaaggttaatgctcctttttctttatctgacctctcccaaaatcagttagcatttaggctctttttcatcaaacatgaaaagtccagcccagttcatggcctgcttagcagcaaccctgagacgttttacagccctagaccctgaaaggtcaaaaggccaacttattctcaatatacattttattttattacccactctgctccagacattaaataaagctccaaaaattaaattccagccctcaaaccccactacaggacttaattaacctcaccttcaaggtgcacaataatagagtagaggcagccaagtagcaacatacttctgagttgcaattccttgcctccactgtgagacaaaccccagccacatctccaacacacaagaacttccaaatgcctaaaccgcagtggccaggcattcctccaggcctgtctcccccaggagcttgctacaagtgccagaaatctggccaccaggccaaggaatgcctgcagcccaggattcctcctaagctgtgtcccatctgtgcaggaccccactggaaatcagactgtccaattcacccagcagccactcccagagcccctggaactctggcccaaggctctctgactccttcccagatcttcttggcttagcggctggagactgacgctgcctaatcacctcagaagcttcctggaccatcacagatgctttaagtaactctcacagtggaaggtaagtccatccccttcttaatcaatacggaggctacacactccacattaccttcttttcaaaggcctgtttcctttgcctccataactgttgtggatattgatggcctggcttctaaacctcttaaaactccccaactctggtgccaacttagacaatactcttttaagcactccttttagttatccccacctgcccagttcccttattaggccgagatattttaactaaattatctgcttccctaactattcctgggctacagccacacctcattgccaccttttcccccagttcaaagcctccttcacatcctccccttgtgtctccccaccttaaaccacaagtataggacacctctactccctccttggtgaccgatcatccaccccttaccatctcattaaaacctaatcacccttaccccgctcaacgccaatatcccatcctgcagcacactttaaaaggattaaagcctgttatcactcgcctgctacagcatggccttttaaagcctataaactctccttacaattcccccattttacctgtcctaaaaccagacaagccttacaggttagttcaggatctgtgccttatcaaccaaattgttttgtctatccaccccatggtgccaaacccatatactctcctatcctcaataactccctctacaacccattattctgctctggatctcaaacatgctttctttactattcctttgcacccttcatcccagcctctcttcgctttcacttggactaaccctgacacccattgggctcagcaaattacctgggctgtactgccgcaaggcttcacagacagcccccattacttcagtcaagcccaaatttcttgctcatctgttacatatctcggcataattctcataaaaacacacgtgctctccctgccaatcatgtccgactgatctctcaaaccccaacaccttccacaaaacaataactcctttccttcctaggcatggttggatacttttgactttaaatacctggttttgccatcctaacaaaaccattatataaactcacaaaaggaaacctagctgaccccatagatcctaaatcctttccccactcctctttccgttccttgaagacagctttagagactgcccccaccctagctctccctgactcatcccaacccttttcattacccataggcaaagtgcagggctatgcagtcagaattcttacacaagaaccgagaccatgccctgtagcctttttatccaaacaatttgaccttactgttttgcctagccctcaagtctgcatgtggcggccgctgctgccctaatacttttagaggcccttaaaatcacaaactatgctcaactcgctctttacagttctcataacttccaaaatctattttcttcctcacacctgacacatatactttctgctccccggctccttcagctatactcactctttgctgagtctcccacaattaccattgttcctggcccagacttcaatccagcctcccacattattcctgataccacacctgactcccatggctatatctctctgatccacctgacattcaccccatttccccatgtttccttctttccacaccctgatcacacttggtttattgatggcacttccaccaggcctaattgccacacaccagcaaaggcaggctatgctgtagtacaagccactagcccacctcttagaacttctcatttcctttccatcgtagaaatctatcctcaaggaaataacttctcagtgttccatctgctattctactactcctcagggattattcaggccccttcccttccctacacatcaagctcgtggatttgcccccacccaggactggcaaattggctttactcaacttgccccgagtcaggaaactaaaatacctcttggtctgggtagacactttcactggataggtagaggcctttcccacagggtctaagaaggccaccatggtcatttcttcccttctgtcagatataattcctcagtttggccttcccacctctatacagtcctataacagactggcctttattagtcaaatcacccaagcagtttgtcaggctcttagtattcagtgaactaatggtcttttaaaaacacagctcaccaagctcagccaccaacttaaaaaaaggactggacaatacttttaccacttgcgcttctcagaattcgggcctgtccttggaatgctacagggtacagtccatttgagctcctgtatagacgctcctttttattaggccccagtctcattccagacaccagagcaacctggactgcgccaccccctcacccaaaaaaaaaaaaaacttgtcatccctactatcttctatctggtcatactcctattcactattctcaactactcataaatgccctgctcttgtttacactgccggtttacactatttctccaagccatcacagctgatatttcctgttgctatccccaaactgccactcttaactccctcttaaagtaaataaataatctttgctgtcagggctatgctgaacctccttaggcactctctagttagatgccctgggtcctcccaattcttagtcctttaatacctgcttttcgtcttgtcttattccgttcttttttcaattcgtacaaaaccatatccaggccatcaccaataattctatatgacaaatgtttcttctaacaaccccacaatatcacccgttaccacaaaatcttccttcagcttaatctctcccgctgtaagttcccacgccgcccctaatcccgctcgaagcagccctgagaaacatcgcccattatctctccataccacccccaaaaattttccccgccccaacatttgaacattattgttttatttttcttattaatataagaagacaggaatgtcaggcctctgagcccaagctaagccatcttatcccctgtgacctgcacgtatacatccagatggcctgaagtaactgaagaataacaaaagtgatatttaaatggcctgttcctgccttaactgatgacattccaccacagaagaagtgaaaatggccagtccttgccttaagtgatgacattaccttgtgaaattccttctcctgactcatcctggctcaaaaactcccccactgagcacattgtgacccccactcctgcccaccagagaacaactcccctttgactgtaattttcctttacctacccaaatcttataaaacggccccacccctgtcttccttctctgactctcttttaggactcagcccacctgcacccaggtgaaataaacagccctgttgctcacaaaaa

SEQ ID NO: 330 - DNA, 438 bp, Homo sapiens
atcaggcctctgagcccaagctaagccatcgtaacccctgtgacctgcacgtatacatccagatggcctgaagcaagtgaagaatcacaaaagaagtgaaaatggccggttcctgccttaactgatgacattccaccattgtgatttgttcctgccccaccttaactgagcaattaaccttgtgaaattccttcacctggctccaaacctcccccactgagcaccttgtggcccctgcccctgcccataagagaaaaacccactttgattgtaatttttcactacctacccaaatcctataaaacagccccacccacccctatctcccttcactgactctctttttggactcagcccgcctgcacccaggtaaaataaacagccccgttgctcacacaaagcctgtttggtggtctcttcacatggacgtgcatgaaa

SEQ ID NO: 331 - DNA, 302 bp, Homo sapiens
tcaacccctgacctaactggttatttgcataaaaaagcactgtgaagatccctgtcctattctgctctgttctaattacaggcgtatgcaacccccagtcacttacccactgcttgctcaatcgaacacgaccctctcatgtggacccccttagagttgtgagcccttaaaatggacaggattgctcactccaggagctcggctcttgagacaggagtcttgccgatgctcccagccaaataaaccccttccttctttaacttggtgtttgaggggtttcgtctgtggctcttcccgctaca

SEQ ID NO: 332 - DNA, 5839 bp, Homo sapiens
caggcctctgagcccaagccaagccatcgcatcccctgtcacttgcacgtatacacccagatggcctgaagtaactgaagaatcacaaaagaagtgaatacgccctgccctccttaactgatgacattccaccacaaaagaagtgcaaacggccggtccttgccttaactgatgacattaccttgtgaaagtccttttcctggctcatcctggctcaaaaagcacccccactgagcaccttgcaacccccactcctgccctccagagaacaacccccctttgactataattttcctttacctacccaaatcctataaaacagccccacccctaactcccttcgctgactctctttttggactcagcccgcctgcacccaggtgaaataaacagccacgttgctcacacaaagcctgtttggtggtctcttcacacggatgcgcatgaaatttggtgctgtgactcggattgggggacctcccttgggagatcaatcccctgtcctcctgctctttgctccatgagaaagatccacctatgacctcaggtcctcagactgaccagcccaagaaacatctcaccaatttcaaatccggtaagtggcctctttttactctcttctccaacctccctcactatccctcaacctctttctcctttcaatcttggcgccacacttcaatctctcctttctcttaatttcaattcctttcattttttggtagagacaaaggagacacattttatccgtggacccaaaactccggcgccggtcacggactgggaaggcagctttcccttggcgtttaatcattgcagggacacctctctgattattcacccacgtttcaagggtgtcagaccacgcagggatgcctgccttggtccttcacccttagcagaaagtcccgcttttcaggggaaggggcaagtaccccaaccccttctctccttgtctctaccccttctctgcttttccagggaaaaggcaagtaccccttctctccttgtctctaccccttctctgcttttctggggaaagggcaagtaccccaaccccttctctccatgtctctaccccttctctgcttttctgggggaggggcaagtacccctcaaccccttctccttcacccttagcggcaagtcctgctttcctagggggcaagaactccccaatcccttatttctgaaccccgacctcttatctctgtgccccaatcccttatttctgaaccccaacctcttatctctgtgccccaattccttatttccatggcccaaccctttctctgcttttctggagggcaagaaccccccacctcttcctgtgtctctactcttttctctgggcttgcctccttcactatgggcaagtttccaccttccattcctccttcttctcccttagcttatattcttaagaacttaaaacctcttcaactctcacctgacctaaaatctaagcatcttattttcttctgcaatgccgcttgaccccaatacaaacccgacagtagttccaaatagccggaaaatggcgctttcaatttttccatcctacaagatctaaataattcttgtcataaaataggcaaatggtctgaggtgcctgatgtccaggcattcttttacacatcagtcccttcctagtctctgtgcccagtgcagctcatcccaaaccttccttctttccctcctgcctgtcccctcagtcccaaccccaagcgtcgctgagtctttctaatcttccttttctacagacccatctgccctctcccctcctcgccaggccaaactaggtcccaattctccctcagcctccactcctccaccctgtaatctttttattacctcccctcctcacacctggtcctgcttacagtttcattctttgactagccctcccccacctgcccagcaatttactcttaaaaaggtggttggagccaaaggcatagtcaaggttaatgctcctttttctttatcccaaatcagaagcatttaggctcttttttatcaaatataaaaacccagcccagttcatggctcgttcagcagcaaccctgagacactttacagccctagaccctaaaaggtcaaaaggccatcttattctcaatatacattttattacccaatctgctcctgacattaaataaaactccaaaaattagaatctggccctcaaaccccacaacaggacttaattaacctcaccttcaaggtgtacaataacataaaaaagttgcaattccttgcctccactgtgagacaaaccccagccacatatccagcacacaagaacttccaaatgcctgaaccacagcggccaggcattcctccagaacctcctcccccaggagcttgctacaagtgccagaaatctgaccaccaggccaaggaatgcctgcagcccaggattcctcctaagccatgtcccatctgtgcgggaccccactggaaattggactgttcaactcacctggcagccactcccagagcccctggaactctggcccaaggctctctgactgactccttcttggcttagcggctgaagactgatgctgcctgattgcctcagaagcccggtagaccatcacggatgccgagctttaagtaactctcacagtggagggtaagtccattcccttcttaatcaatacagaggctacccactccacattaccttcttttcaagggcctgtttcccttgcctccataactgttgtgggtattgacagccaggcttctaaacctcttaaaactcccaactctggtgccaaattagaggatactcttttatgcactcttttttagttatccccacctgcccagttcccttattaggctgagatattttaaccaaattatctgcttacctgactattcctggactatagccgcatctcattgctgcccttcttcccaatccaaagcatcctttgcatcctcctctagtattcccccaccttaacccagaagtataagatacctctactccctccttggtgactgatcatgcaccccttaccatctcattaaaacctaatcacccttaccccactcaatgccaatatcccatcccacagcatgctgtaaaaggattaaagcccgttatcacttgcctgctacagcatgggcttctaaaacctataaactctccttaccattcccccattttacctgtcctaaaaccagacaaggcttacaagttagttcagaatctgtgccttatcaaccaaattgtttcgtctatccaccccatggtgccaaacctgtatactctcctatcctcaatagctccctctactacccattattctgttctggatctcaaacatgctttctttactattcctttgcacctttcatcccagcctctctttgccttcacttagactgaccctgacacccattaggctcagcaaattacctgggctgtactgcctcaaggcttcacagacagcccccattacttcagtcaagcccaaatttcatcctcatctgttacctatctcagcataattctcataaaaacacacgtgctctccctgctgatcatgtctgattaatctcccaaacctcaatcccttaaaaaagagcaactcctttctttcctaggcatggttagtgcggtcagaattcttacacaagggccaggaccacacagtgtaggctttctgtccaaacaacttgaccttactgttttagcctagccctcatgtctgcgtgcagcagctgccactgctttaatactgttagaggccctaaaaatcacaaactatgctcaactcactctctacatttctcataacttccaaaatctattgtcttcctcatacctgacacatatactttctgctccccagctccttcagctgtactcactctttaagtcccacagttaccattgttcctggcccagacttcaatctggcctctcacattattcctgataccacacctgacccccatgactgtatctctctgatccacctgatattcaccccatttccccatatttccttcttttctgttcctcaccctgatcacgcttgatttattgatggcagttctaccaggcctaatcaccacacaccagcaaaggcaggctatgctatagtacaagccactagcccgcctctcagaacctctcatttcctttccatcgtggaaatctatcctcaaggaaataacttctcagtgttccatctgctattctactactcctcagggattattcaggccccctcccttccctacacatcaagctcgaggatttgctgccactcaggactggcaaattagcttactcaacatgccctgattcaggaaactaaaatacctcttagtctaaatagacactttcactgaataagtaaaggcctttcctacagggtctgagaaggccaccacagtcatttcttccctcctgtcagacataattcctcagtttagccttcccacctctatacagtctgataacagaccagcctttattagtcaaatcagccaagcagtttttcaggctcttagtattcagtgaaacctttatatcccttacggtcctccatcttcaagaaaagtagaatggactaaaggtcttttaaaaacacacctcaccaagctcagctaccaacttaaaaaggactggacaatacttttaccactttcccttctcagaattcaggcctgtcttcggaatgctacagggtacagcccatttaagctcctgtatagatgctcctttttattaggccccagtctcattgcagacaccagagcaacttagactgtgccccagaaaacttgtcatccctgctatcttctgtctagtcatactcctatttaccgttctcaactactcatacatgccctgctcttgtttacactgccagtttacactgtttttccaagccatcacaggtgatatttcctggtgctatccccaaattgccactcttaactcttgaagtaaataaataatctttgctggcaggactctgctgaatctccttaggcattctctaatcagatatcctgagtcgtcccaattcttagaccttttatacctgtttttctccttctcttattccatttagtttctcaattcatccaaaaccatatccaggccatcagcaatcattctgtatgacaaatgtttcttgtaacatccccacaatatcaccccttaccacaagacctcccttcagcttaatctctcccactctaggttcccacacagcacctaatcccgcttgaagcagccctgagaaacatcgtccactctctctccataccacccccccaaaatttttgccaccccaacacttcaacactattttgttttatttttcttattaatataagaaggcaggaatgtcaggcctctgagcccaagccaagccatcgcatcccctgtcacttgcacatatatgcccagatggcctgaagtaactgaagaatcacaaaagaagtgaatatgccctgccccaccttaactgatgacattccaccacaacagaagtataaatggctggtccttgccttaagtgatgacattatcttgtgaaagtccttttcctgctcatcatggctcaaaaagcaccccccactgagcaccttgtgacccccactcctgcccgccagagaacaacctccctttgactgtaattttcctttacctacccaaatcctataaaacggccccacccctatctcccttcactgactctcttttcggactcagcccacctgcacccaggtgaaataaacagcctcgttgctcacacaaagcctgtttggcggtctcttcacatggatgcgcatgaaa

SEQ ID NO: 333 - DNA, 8111 bp, Homo sapiens
gagagacaggactagctggatttcctaggccgactaagaatccctaagcctagctgggaaggtgaccgcatccacctttaaacacggggcttgcaacttaactcacacccaaccaatcagagagctcactaaaatgctaattaggcaaaaacaggaggtaaagaaatagccaatcatctattgcctgagagcacagcaggagggacaaggatcgggatataaacccaggcattcgagccggcaacagcaaccccctttgggtcccctccttcctatgggagctttgttttcactctatttcactctattaaatcttgcactgcactcttctcgtccatgtttgttacggctcgagctgagcttttcgctcgccgtccaccactgctgtttgccactgtcgtagacccgcccctgactcccatcccgccactgactcccatccctccagatccggcagggtgtccgctgtgctcctgatccagcaagactccggttgccactcctgattttgctaaaggcttgccattgttcctgcacggctaagtgcctgggttcgtcctaattgagctgaacactagtcactgggttccacggttctcttccatgacccacagcttctaatagagctataacactcactgcatgatccaagattccattccttggaatccgtgaggccaagaatcccgggtcagagaacacaaagcttgccaccatcttggaagcggcccaccaccatcttggaagcggcttgccaccatcttgggaactctgtgagcaagggcctcaggtaacattttggtgaccacgaagtgacctccaaagcggtgagtaatattggaccactttcgcttgctattctgtcctatccttccttggaattggaggaaaataccgggcacctgtcgaccagttaaaaacgattagcatggccgccggacttaagactcaggtgtgagactatctggcgaagggctttctaacaacccccaacccttctggcttggggacgttggtctggtcggagcagcttccactttcaattttcatggggaagccgagggccgactagaggcagaaagctgtcatcccgaactcctggcagtagccggttgagatcatggcgcagccagaattctctactcagtagatgcccatccgtgcgcccctacctttcccttctgatccatacctcctgggtcccgaccatgactttcttgaaagcatagcccccaaattctccttacctctgaatctacttcctctgatccttgcgtcctaggtactaatggttcagactttcatttcctctagcaagttgtatctccaaagggatctcaggaagctctatgctgtgtccttaggcatctaggctgtaacccagggagtcttatccctggtgtccctcccgatttaggtatacagctctcgacatgggcagttatgtgggacccattccccaccacccttgccaggggcccaagtctgtaatggctaagagagagatggagagagagagacagatggagagagagagagagagagacagagagagatggagagagagagacagagagagagagagagacagagagagagacaaagacggagtcaaagagaaagaaagaaaaagatagaaatagtaaaaagaaaagtgtgccctattcctttaaaagccagggtaaatttaaaacctgtaattgataattgaaggtcttctccatgatcctataacactccaatgccactttgttgtcagtgtaaataagggcgtagcccgaaagcactgaggccactgacaacccatagctttcctatcaaaaatccttaacccagtaacccacggatggccaaatgcattcagtcggtagcggcaactgctttgctaaaagtagaaaagtaacttttagaggaaacctcgttgtgagcacaccttaccagttcagaattattctaagtcaaaaaaaaaaaaaaaaaaaaaaaaaaagcaaaggtagcttactaactcaaaaatcttaaagtatggggctattattttagaaaagggtaatgtaactccaaccactgataattcccttaacccagcagatttcctaacaggggatttaaatcttaattaccatacaaaggtctgaccagacctaggaggaactcccttcaggacaggatggtagatggttcctcccaggtgattaaggaaaaaaaccacaatgtgtattcagtaattgatacagagactcttgtggaagcagagctagaaaaattgcttaacaattggtctcctcaaacgtgcgagctgtttgcactcagccaagccttaaagtacttacagaatcaaaacactacctcaatcctgactccaaagattcgctacatcctctctggaatgaatttgcataagaactattgtttatggggatgcatcttcatggggcagctgggttgttatgaaatactcgggaacccggcccagctctaggactcactcctgagcacaaaggcaatgttgggcacgctggtaaaggatcactagaatcctgcagcccgaacccctctctttgtggtcaagagaggcgctaaaataggtgcagggctgctacattggtgagcataactaatctgataagcagaggtccatgggtggttacgcaccctggaaaagaataagcattaggcccttagaggacgctctaggactaatgcttatcggaaaatgactaggggtgctggcatccctatgttcttttttcagatgggaaacgttccccccaccccaaagcaaaaatgcccctaagatgtactctggagaattaggaccaatttgaccctcagatgctaagaaagaaatgacttatagtcttctgcagtactgcctggccacaataccctcttaaaagggagaaacctggccttctgagggaagtataaattataacactatcttacagctagacctcttctgtagaaaggagggcaaatggagtgaagtgccatatgtgcaaactttcttttcattaagagacaactcataattacgtaaaaaatgtggtttatgccctacaggaagccctcagagtctacctccctatcccagtgtccccccgactccttccccaactaataaggaccccccttttacccaaatggttcaaaggagatagacaaagggataaataatgaaccaaacagtgccaatattccgattatgccccctccaagcagtgggaggaggagaattcggcccagccagagtgcatgtacctttttctctctcagacttaaagcaaattaaaatagacctaggtaacttctcagataaccctgatggctatattgatgttttacaagggttaggacaatcttttgatctgacatggagagatataatgttactgctaaatcagacattaaccccaaatgagagaagtgccgccacaactgcagcccgagagtttggcaatatctggtatctcagttaggtcaatgataggatgacaacagaggaaagagaatgattctccacaggccagcaggcagttccgagtgtagcccctcactgggacacagaatcagaacatggagattggtgccgcagacatttgctaacttgcatgctagaaggactaaggaaaactaagaagactatgatttattcagtgatgtccactataacacagggaaaggaagaaaatcctactgcctttctggagagactaagggaggcatggaggaatcatacctctctgtcacctgactctattgaaggccaactaatcttaaaggataagtttatcactcagtcagctgcagacattagaaaaaaacttcaaaagtccaccttaggcccagcgcaaaatttagaaaccctattgaacttggcaacctcagttttttataatagagatcaggaggagcaggcggaatgggactaacgggataaaaaaataaaaggccaccactttagtcatggccctcaggcaagcggactttggagtctctggaaaagggaaaagctgggcaaattgaatgcctgatagggctttcttccagtgcagtctacaaggacactttaaaaaagattgtccaagtagaagtaagctgccctctagtccacgccccttatgtcaaaggaatcactggaaggcccactgccccaggggacaaaggtcatctgagttagaagccactaaccagatgatccagcagcaggactgagggtgcctggggcaagtgccagcccatgccatcaccctcacagagcccctgatatgcttgaacattgagggccaggaggttaactgtctcctggacactggcacggccttctcagtcttactctcctgtcccggacaactgtcctccagatctgtcactatcctaggggtcctaggacagccggtcactagatacttctcccacccaccaagctgtgaccgaggagctttactcttttcacatgtttttctaattacacctgaaagccccactcccttgttagggagagacattccagcaaaagcaggggccattatacacctgaacataggagaaggaacacctgtttgttgtcccctgcttgaggaaggaattaatcctaaagtctaggcaacagaaggacaatatagatgagcaaagaatgcccatcctgttcaagttaaactaaaggattctgcctcctttccctaccccctcagacccaaggcccaacaaggactccaaaagattgttaaggacctaaaagcccaaggcctagtaaaagcatgcaatagccactgcagtactccaattttaggagtacagaagcccaacagacagtagaggttagtgcaagatctcaggattatcagtgaggctgttgttcctctatacccagctgtacctagccctcatactctgctttcccaaataccagaggaagcagagtggtttatagtcctggaccttaaggatgcctttttctgcatccctgtacatcctgactctcaattcttgtttgcctttgaagatccttcaaacccaacgtctcaactcacctggactgttttactcaagggttcaaggatagcccccatctatttgaccaggcattagcccaagacttgagccaattctcatatatggacactcttgtccttcggtatggggatgatttaattttagccacccattcagaaaccttgtgccatcaagccacccaagcgctcttaaatttccttgctacctgtggctacaaggtttccaaactaaaggctcagctctgctcacagcaggttaaatacttagggctaaaattatccaaaggcaccagggccctcagtgaggaacgtatccagcctaaactggcttatccttatcccaaaaccataaagcaactaagagggttccttggcataacaggcttctgccgaatatggattcccaggtacagcaaaatagccaggccattatatacactaattaaggaaactcagaaagccaatacccatttagtaagatggacacctgaagcagaagcagctttccaggccctaaaataggccctaacccaagccccagtgttaagcttgccaacggggcaagacttttctttatatgtcacagaagaaacaggaatagctttaagagtccttacacaggtccgagggatgagcttgcaacccgtggcatatctgagtaaggaaaatgatgtagtggcaaagggttggcctcattgtttatgggtagtggcagcagtagcagtcttagtatctgcagcagttaaaataatacaggagatcttactgtgtggacatctcatgatgtgaacagcatacacagtgctaaaggagacttgtggctgtcagacaaccatttacttaaatatcaggctcttacttgaagggccagtgctgcaactgcgcacttgtgcaactcttaacccagccacatttcttccagacaatgaagaaaagatagaacataactgtcaacaagtaattactcaaaccaactccactcgaggggaccttttagaggttcccttgactgatcctgacctcaacttgtatactgatggaagttcctttgtagaaaaaggactttgaaaagcggggtatgcagtggtcagtgataatggaatacttgaaaataatcccctcactccaggaactagtgctcagctggcagaactaatagccctcactcgggcactagaattaggagaagggaaaagggtaaatatatatacagactctaagtatgcttacctagtcctccaggcctatgcagcaatatggagagaaagagaattcctaacttctgagggaacacctatcaaacatcaggaagccattaggagattattattggctgtacagaaacctaaagaggtggcagtcttacactgccggggtcatcagaaaggaaaggaaagggaaatagaagggaactgccaagcagatattgaagccaaaagagctgcaaggaagccattaggagattattattggctgtacagaaacctaaagaggtggcagtcttacatcaggaagccattaggagattattattggctgtacagaaacctaaagaggtggcagtcttacactgccggggtcatcagaaaggaaaggaaagggaaatagaagggaactgccaagcagatattgaagccaaaagagctgcaaggcaggaccttccattagaaatgcttatagaggacccctagtatggggtaatcccctccaggaaaccaagccccagtactcagaagaaaaaatagaatgaggaacctcatgaagacatagtttcctcccctcaggatggccagccaccaaagaaggaaaaatacttatgcctgcagctaaccagtagaaattacttaaaaccctttaccaaacctttcactttggcattgatagcacccatcagatggccaaattattatttactagaccaggtctttcaaaactatcaagcggatagtcagggcctgtgaagtgtgccaaagaagtaatcccctgcactgcaggccatacatttcaatccctgtatctttaacctccttgttaagtttgactcttccagaattaaaactgtaaaactacaaattgttcttcaaatggagccccagatgcagtccatgactaagatccactgcggacccctggaccggcctgctagcccatgctccgatgttaatgacatcgaaggcacccctcctgaggaaatctcaactgcacaacccctactatgccccaattcagcaggaaacagagcagtcattggccaacttccccaacagcacttgggttttcctgttgagaggggggactgagagacaggactagttggatttcctaggccaactaagaatccctaagcctagctgggaaggtgaccgcatccacctttaaacatggggcttgcaacttaactcacacccaaccaatcagagagctcactaaaatgctaactaggcaaaaacaggaggtaaagaaatagccaatcatctattgcctgaaagcacagcgggagggacaaggatcgggatatgaacccagacattcgagccggcaacagcaaccccctttgggtcccctcccttcctatgggagctctgttttcactctatttcactctgttaaatcttgcaactgcactcttctcgtccatgtttgttacggctcgagctgagcttttcgctcgccgtccaccactgctgtttgccactgtcgcagacccgcccctgactcccatcccgccactgactcccatccctccagatctggcagggtgtccactgtgctcctgatccagcgagactcccattgccactaccgatcgtgctaaaggcttgccattgttcctgcacggctaagtgcctgggttcgtcctaattgagctgaacactagtcactgggttccacggttctcttccatgacccacagcttctaatagagctataacactcaccacatgatccaagattccattccttggaatccgtgaggccaagaaccccaggtcagagaacacaaggcttgccaccatcttggaagcggcctgccactatcttggaagcggcttgccaccatcttgggagctctgtgagcaaggacccccggtaaca

SEQ ID NO: 334 - DNA, 4410 bp, Homo sapiens
cttctcccttagcctgtgttcttaagaacttaaaacctcttcaactctcacctgacctaaaatctaagcgtcttattttcttctgcaatgccccttgaccccagtacaaactcgacagtagttctaaatagccagaaaacagcactttcaatttttccatcctacaagatctaaataattcttgtcgtaaaatgggcaaatggtctgaggtgcctgacgtccaggcattcttttacacattggtctctccctagtctctgtgcccagtgggactcgtcccaaatcttccttctttccctcccgcctgtcccctcagtcctaaccccaagcgtcgctgagtctttctaatcttccttttctacagacccacctgacctctcccctcctccccaggctgctcctcgccaggccgagctaggttccaattcttcctcagcctgtctccaccctataatctttttatcacctcccctcctcacacctggtccggcttacagtttcgttccgtgactagccctcccctacctgcccagcaatttactcttaaaaaggtggctggagctaaaggcatagtcaaggttaatgctcctttttctttatcccaaatcagaagcgtttaggctctttttcatcaaatataaaaatccagcccagttcatgactcgtttggcagcaaccctgagacactttacagccctagaccctaaaaggtcaaaaggccgtcttattcttaaaatacattttattatccaatctgctcctgacattaaatgaaactccaaaaattaaattctggccctcaaaccccacaacaggatttaattaacctcaccttcaaggttacaataatagaaaaaagttgcaatttcttgcctccactatgagacaaaccccagccacatctccagcacataagaacttccaaacgcctgaaccgcagtggccaggcattcctccagaacctcctcccccaggagcttgctgcaagtgccagaaatctgaccactgggccaaggaatgcccgcagcccaggattcctcctaagccgtgacccatctgtgtgggaccccactgaaaattggactgttcaactcacctggcagccacttctagagcccctggaactccggcccaaggctctctgactgactccttcccagatcgtcttggcttagcggctgaagactgacgctgcccaatcgcctcagaagccccctagaccatcacggacgccgagctttgggtaactctcacagtggagggtaagtctgtccccgtcttaatcaataccgaggctactcactccacattaccttattttaaacggcctgtttcccttgcctccataactgctgtgggtattgacggccaggcttctaaacctcttaaaactccccaactccggtgctaacttagacaatactcttttaagcactcctttttagttatccccacctgcccagttcccttattaggctgagacactttaactaaattatctgcttccctgactattcctggattacagctgcatctcattgctgcccttcttcccaatccaaagcctcctttgcgtcctcctcttgtattcccccaccttaacccacaagtataaaatacctctactccctccttggcgatcgatcatgcaccccttaccatctcattaaaacctaatcacctttaccccactcaatgccaatatcccatcccacagcatgctttgaaaggatgaaagcctgttatcactcgcctgctatagcatggccttctaaaacctataaactccctttacgatgtccccatttcacctgttctaaaaccagacaaggcttacaggttagttcaacatctgcgccttagcaaccaaattgttttgcctatccaccctgtggtgccaaacccatatactctcctatcctcaataactccctccacaatccattattctgttctagatctcaaacatgctttttttactattcctttgcacccttcatcccagcctctctctgctttcacttggactgaccctgacacccatcaggctcagcaaattacctgggctgtactgctgcaagtcttcacagacagcccccattacttcagtcaagcccaaatttcttccttatctgttacctatctcggcataattctcataaaaacacatgtgctctccctgctgattgtgtccgattaatctcccaaacctcaatcccttacaaaacaacaactcctttccttcctaggcatggttagtgtggtcagaattcttacacaagaggcaggactgcaccctgtagcctttctgtccaaacaacttgaccttactgttttagcctagccatcatgtctccgtgcagtggctgctgccgctctaatacttttagaggccctcaaaatcacaaactatgctcaattcactctccacatttctcataacttccaaaatctattttctttctcatacctgatgcatatgctttctgctccccggctccttcagctgtactcactctttgttaagtcccacaattaccgttgttcctggcccatacttcaatccggcctcccacattattcctgataccacacctgacctccatgactgtatatctctgatccacctgacattcaccccatttccccatatttccttctttcctgttcctcaccctgatcacgcttgatttattgatggcagttccaccaggcctaattgccacacaccagcaaaggcaggctatgccaggcacaagccactagcccacctcttagaacctctcattttctttccatcgtggaaatctatcctcaaggaaataacttctcagtgttccatctgctattctactactcctcagggattattcaggccctctcccttccctacacttcaagctcgaggatttgcccccacccaggactggcaaataagctttactcaacatgccctgagtcagataactaaaatacctcttagtctaggtagacactttcactggataggtacaggcctttcctacagggtctgagaaggccaccgcagtcatttcttcccttctgtcaggcataattcctcagtttagccttcccacctctatacagtctgatagcagaccagcctttattagtcaaatcagccaagcagtttttcaggctcttagtattcagtgaaacctttatatcccttacggtcctccgtcttcaagaaaagtagaacggactaaaggtcttttaaaaacacacctcaccaagctcagccaccaacttaaaaaggactggacaatacttaccactttcacttctcagaattcaggtctgtcctcggaatgctacaaggtacagcccatttgagctccttttaattaggccccagtctcattccagacatcagaccaacttggactgtgccccagaaaacttgtcatccctactatcttctgtctagtcatactcctattcaccattctcaactactcatacatgccctgctcttgtttacactgacagtttacactgtttctccaagccagcacagctgatatctcctggtgctatccccaaactgccactcttaactcttgaagtaaataaataatctttgttggcaggactatgctgaatctccttaggcactctctaatcagatgtcctgagttgtcccaattcttagaccttttatacctgtttttctccttctcttattccatttagtttttcaattcatacaaaattgtatccaggccatcaccaataattctaaatgacaaatgtttcttctaacaaccccacaatatcaccccttaccacaaaatcttccttcagcttaatctctcccactctaggttcccacgccgccccaatcccgctaaaagcagccctgagaaacatcgcccattatctctccatagcacccccaaaaaatttttcaccatcccaacactttaccactatttcattttatttttcttattaatataagaagacaggaatgtcaggcctctgagcccaagctaagccatcatatcccctgtgacctgcacgtacacatccagatggccggttcctgccttaactgatgacattccaccacaaaaagaagtgaaaatggcctgtttctgccttaactgatgacattgtcttgtgaaattccttctcctggctcatcctggctcaaaagctcccccactgagtaccttgtgacccccactcctgcccgccagagaacaacccccctttgactgtaattttcctatacctacccaaatcctataaaatggccccacccctatctccccttgctgactctcttttcggactcagcccgcctgcacccaggtgaaataaacagccatgttgctgacaaaaagcctgtttggtggtctcttcacacggacgcgagtgaaa

SEQ ID NO: 335 - DNA, 382 bp, Homo sapiens
gccaggcctctgagcccaagctaagccatcataacccctgtgacctgcacatatacatccagatggcctgaagcaactgaagaatcacaaaagaagtgaaaatggcctgttcctgccttaactgatgacattaccttgtgaaattccttctcctggctcagaagctcccgactgagcaccttgtgaccctcgcccctgcctcccagagaacccctttgactttaattttccataacctacccaaatcctataaaactgccccacccatatctctcttcgctgactctcttttcggactcagcccgcctgcactgaggtgattaaaaagctttattgctcacacaaagcctgtttggtggtctcttcacacggacacgcatga

SEQ ID NO: 336 - DNA, 4076 bp, Homo sapiens
gtcaggcctctgagcccaagctgagccatgatattccctgtgacctgcacgtacacatccagatggccagttcctgccttaactgatgacattccaccacaaaagaagtgaaaatggcctgttcctgccttaactgatgacaatgtcttgtgaaattccttctcctggctcatcctggctcaaaagctcccccactgagtaccttgtgacccccactcctgcccgccagagaacaaccccctttttccttcacctatccaaatcctataaaacggccccacccccatctcccttcgctgactctcttttcggactcagcccgcctgcacccaggtgaaataaacagccatgttgctcacacaaagcctgtttggtggtctcttcactcagacacgcaggaaatttggtgccgtgacttggattgggggacctcccttgagagatcaacccctgtcctcctgtcctttgctccgtgagaaagatccacctacgacctcaggtcctcagacctaccagcccaaggaacatctcaccaattttaaatcgggtgagcggcctcttcttactctcttctccaacctctctcactgtccctcaaccactttctcctttccactcttcaatctctcccttctcttaatttcaattcctttcattttctggtagagacaaaggagacacgttttatccgtggacccagaactctggcaccggtcaaggactagggaaggcagccttcccctggtgttgaatcattgcagggatgcctctctgattatttacccatgtttcagaggtgtcagaccatgcagggacacctgcctttgtccttcatccttagcggcaagttccgcttttctgtgggaggggcaagtaccccaaccccttctctccgtgtctctacaccttctctgcctttctggggggcaagaaacccccaaccccttcttcttcacccttagcagcaagtcccgcttttctaggggagggataattaccccaaccccttatatctctgtgccctgatcccttatttccgtgccccaagctcttatatctctgcaccccaatcccttatttccatgccccaacctcttatatctctgcaccctgatcccttatttcctcgcccaacctcttatatctctgtgccccaatcccttatttccgtgccctgacctcgtatctctgtgccccatcccctttcccacttttctggagggtaagaacccccgaaccccttccctccgtgtctctactctctcttttctctgggcttgcctccttcactatgggcaaccttccaccctccattcctccttcttctcccttagcctgtgttcttaagaacttaaaacctcttcaactctcacctgacctaaaatctaagcatcttattttcttctgcaatgccacttgaccccaatacaaactcgacagtagttccaaatagccagaaaacggcactttcgatttttccatcttacaagatctaaataattcttgttgtaaaatgggcaaatgatctgagatgcctgacgtccaggcattcttttacacatcggtccctctctagtctctgttcccaatgcaactcatcccaaatcttccttctttccctcctgtctgtcccctcagtcccaaccccaagcgtctctgagtctttctaatgttccttttctacagacccatctgacctctcccctcctccccaggctgctcctcgccaggccgagctaggtcccaattcttcctcagcctccactcctccaccctataatccttttatcacacctcccctcctcacacctggtccggcttacagttttgttccatgactagccctcccccacctgcccagcaatttactcttaaaaaggtggctggagctaaaggcatagtcaaggttaatgctcctttttctttatcccaaatcagacagcatttaggctctttttcatcaaatataaaaatccagcccagctcatgactcgtttggcagcaaccctgagatgctttacagccctagaccctaaaaggtcaaaaggccgtcttattctcaaaatgcattttattacccaatctgctcccgacactaaataaaactccaaaaattaaattccggccctcaaaccccacaacaggatttaattaacctcgccttcaaggtgtacaatagtagaaaaaagttgcaattccttgcctccactgtgagacaaaccccagccacatctccagcacacaagaacttccaaatgcctgaaccgcagcggccagacatttctccagaacctccttccccaggagcttgctacaagtgccagaaatctggccacaaggccaaggaatgcctgcagcccaggattcctcctaagccgcgtcccatctgtgcgggactccactggaaatcggactgtccaactcacctggcagccactcccagagcccctggaactctggccgaaggctctctgactccttcccagatcttcttggcttagtggctgaagactgatgctgcccaatcgcctcgaaagccccctagaccatcacggacgctgagcttcaggtaactcacacagtggagggtaagtccgtccccttcttaatcaatacggaggctactcactccgcattaccttattttcaagggcctgtttcccttgcttccataactgtggtgcgtattgacagccaggcttctaaacctcttaaaactccccaaatctggtgccaattagacaatactcttttaagcattccttttagttatccccacctgcccagttcccttattaggctgagacactttaactacattatctgcttccctgactattcctggattacagttacatctcatggctgcccttcttcccaatccaaagcctcctttgcgtcctcctcttgtattcccccaccttaacccacaagtataagatacctctactccctccttggcaaccgatcatgcaccccttaccatctcattaaaacctaatcacccttaccccgattgatgccaatatcccatcccacagcatgctttgaaaggattaaagcctgttatcactcgcctgctacagcatggccttttaaagcctataaactctccttacaattcccccattttacctgtcctaaaaccagacaagcctttcaagttagttcaggatctatgccttatcaaccaaattgttttgcctatctaccccatggtgccaaacccatacactctcctatcctcaatacctccctccacaatccattattctgttctggatctcaaacatgctttcttcactactcctttgcacctgtcatcccagcctctcttcgctttcacttagactgaccctgacacccatcaggctcagcaaattacctgggctgtactgccgcaaggcttcacagacagcccccattacttcagtcaagcccaaatttcatcctcatctgttacctatctcggcataattctcataaaaacacatgtgctttccctgctgattgtgtccgattaatctcccaaacctcaatcccttacaaaacaacaactcctttccttcctaggcatggttagtgcggtcagaattcttatacaagagccaggaccacaccctgtagcctttctgtgcaaacaacttgacctgttttagcctagccatcatgtctccgtgcagtggctgctgccgccctaatacttttagaggccctcaaagtcacaaactatgctcaacttactctctacatgtctcataacttccaaaatctattttcttcctcatacctgacacatatactttctgctccccagctccttcagctgtactcactctttgttaagttccacaattaccattgttcctggcccggacttcaatccggcctcccacattattcctgataccacaactgacacccatgactgtatctctctgatccacctgacattcaccccatttccccgtatttccttctttcctgttcctcatcctgatcatgcttgatttattgatggcggttccatcaggcctaattgccacacaccagcaaaggcaggctatgctatagca

SEQ ID NO: 337 - DNA, 931 bp, Homo sapiens
aaaacactcaaagctcaattggttaaacaaaaaaaggaaaaagacagtaaggagtataacactacccagatgcaacttaatctaacactctatactttaaactttctaaacatacatagaaatcagaccgctacctctgcagaacattttactggtaaaaagaacagcccacatgagggaaaactgatttggtggaaagacaacaaaaacaaaacatgggaaatagggaaggtgataacatggggaagaggttttgcttgtgtttcaccaggagaaaatcagcttcctgtttggatacccactagacatttgaagttctacaatgaacccatcagagatgcaaatgaaaatgcctccgcagagacagaaaacccgcaatcgagcatcgtcgactcgcagggtgaacaaaatggtgatatcagaagaaccaatgaagttaccatccaccaagaaaacggcacatgtggagagccagggagaagaatagaaagaaaaagagacagagatcagagacagacacagaaagtgagactggggagagagatagtataaaagagagagactgtaagagaaaggagacaaagagataaaaggtgcgagtgaacaggtgaggagaaagaccgaaaactatgagaaacagcaactaagacacaaaggaggtgggagactgcctgggtactgcagcacccacaccgtcctcttgccccctgtcacttgggttaaaaccactggaaattgcactgttgcaaattttgtattaatccttgtatgtctgtcctttctattggtagtttacaggtgtatccagcagctccagagagacagcgaccagcgagaaggggccataatgatggtggcggttttgtcaaaaagaaaagggggatatgcagggaaaagaaagagagatcagactgttactgtgtctacatag

SEQ ID NO: 338 - DNA, 5666 bp, Homo sapiens
gtcaggcctctgagcccaagctaagccatcatatcccctgtgacctgcacctacacatccagatggccggttcctgccttaactgatgacattccaccacaaaagaagtgaaaatggcctgttcctgccttaactgatggcattatcttgtgaaattccttctcctggctcatcctggctcaaaagctcccctactgagcaccttgggacccccactcctgcccgccagaaaacaacccccctttttcctttacctacccaaatcctataaaatggccccacccctatctcccttcgctgactctcttttcggactcagcctgcctgcacccaggtgaaataaacagctttattgctcacacaaagcctgtttggtggtctcttcacacggacgcaagtgaaatttagtaccgtgactcagatcggggggacctcccttgcgagatcaatcccctgtcctcttcctctttgctctgtgagaacgatccacctacaacctcgggtcctcagaccaaccagcccaagaaacatctcaccaatttcaaatccggtaagtggcctctttttactctcttctccaacctccctcactatccctcaacctctctcctttcaaccttggtgccactcttcaatctctcccttctcttaatttcaattcctttcattttctggtagagacagagacacgttttatccgtggacccaaaactccagcgccggtcacggactaggaaaggcagccttcccttggtgtttaatcattgcagggacacctctctaatcagagaggtttcagaggtgtcaggccccacagggacgcctgccttggtccttcacccttagcggcatgtcctgcttttctgggggagggacaggaacccaacctcttatctctgtgccccgatcccttatttccatgccccaaccccttctctgcttttctggagggcaagaacgccccaccccttctctgtgtctctactctcttttctctgggcttgcctccttcactatgggcaaggtttcagcttccattcctccttcttctcccttagcctgtgttcttaagaacttaaaacctcttcaactctcacctgacctaaaatctaagcatcttattttcttctgaaatgccgcttgaccccaatacaaacacgacaacagttccaaatagccagaaaacggcactttcaatttttccatcctacaagatctaaataattattgtcataaaatgggcaaatggtgtgaggtgctggatgtccaggcattcttttacacatcagtgcctccctagtctctgttcccagtgcagctcctcccaaatcttccttctttccttcccgcctgtccctcagtcccaaccccaagcatctctgagtctttctaatcttccttttctacagacctatctgacctctcccctcctcgccaggccgagctaagtcccaattcttcctcagcctccgctccttcatcctgtaatccttttatcatctcccctcctcacacccggtccggcttacagtttcgttccgtgactagccctcccccacctgcccagcaatttactcttaaaaaggtggctggagctaaaggcatagtcaaggttaatgctcctttctctttatcccaaatcagatagcgttttcatcaaacataaaaatccagcccagttcgtggctcgtttggcagcagccctgagacgctttacagccctagaccctaaaaggtcaaaaggccatcttattctcaaaatacattttattacccaatctgctcccgacattaaataaaactccaaaaattaaattccggccctcaaaccccacaacaagacttaattaacctcgccttcaaggtgtacaataatagaggcagccaaatagcaacatatttctgagttgcaattccttgcctccactatgagacaaaccccagccacatctccagcacacaagaacttccaaacgcctaaaccacagcggccaggcgttcctccagaaacgcctcccccaggagcttgctacaagtgccagaagtctggccaccaggccaaggaatgcccgcagcccgggattcctcttaagccatgtctcatctgtgcgggaccccactggaaatcgaactgctcaactcacctagcagccactcccagagccgctggaactctggccggaggctctctgactccttcccagatcttctcggcttagcggctgaagactgacgctgcccgatctcctcggaagccccgtagaccatcacagacgctaagctttaggtaactctcacagtggagggtaagtccgtccccctaatcaatacagagcctatccactccacattaccttcttttcaagggcctgtttcccttgcctccataactgttgtgggtattgatggccaggcttctaaacctcttaaaactccccaactctggtgccaacttaaacaatactcttttaagcactcctttttagttatccccacctgcccagttcccttattagggcgagccactttaactaaattatctgcttccctgactattcctggattacagccacatctcgctgccacccttcttcccaatccaaagcctcctttgcatcctcctcttgtattcccccaccttaacccacaagtatgagatacctctactccctccttggtgaccgatcatgcaccccttaccatctcattaaaacctaatcacccttacctctctcaatgcaaatatcccatcccacagcacactttaaaaagattaaagtctgttatcattcgcctgttacagcatggccttttaaagcctataaactctccttacaatttccccattttacctgtcctaaaaccagacaagacttacaggttagttcaggatctgcgccttatcaaccaaattgttttgcctatccaccccatggtgccaaacctataaactctcatatcctcaatacctccctccacaatccattattctgttctggatctcaaacatgctttctttactattcctttgcacccttcatcccagcctctacttcgctttcacttggactgaccctgactcccatcaggctcacaaattacctgggctgtactgccgcaaagcttcacagacagcccccattacttcagtcaagcccaaatttattcctcatctgttacctatctcggcataattcttgtaaaaacacatgtgctctccctgctaatcgtgtcccactaatctcccaaacctcaatcccttctacaaaacaacaagtcctttccttcctgggcatggttggatactttcgcctttggatacctggttttgccatcctaacaaaaccattatataaactcacaaaaggaaacctagctgaccccatagatcctaaatcctttccccactcctctttccgttccttgaaaacagctttagagactgcatccatcctagctctccctgactcatcccaacccttttcattacacacagccgaagtgcagggctatgcagtcagaattcttacacaaggaccaggatcacatcctgtagcctttgtccaaacaacttgatcttactgttttaggctggccatcatgtctccgtgtagcagctgctgccgccttaatacttttagaggccctaaaaatcacaaactatgctcagctcactctctacatttctcataacttccaaaatctattttcttcctcacacctgacgcatatactttctgatccctggctccttcagctgtactcactctttgttgagtctcccacaattaccattgttcctggcccagatttcaatccggcctcccacattattccggataccacacctgaccctcatgactgcatctctctgatctacctgatgttcaccccatttccccatattttcttctttcctgttcctcaccctgatcacacttagtttattgatggcagttccaccaggcctaatcgccacacaccagcaaaggcaggctatgctatagtacaagccactagcccacctcttaaaacctctcatttcctttccatcgtggagatctatcctcaaggaaataacttctcagtgttccaattgctattctactactcctcagggattattcaggccccttcccttccctacacatcaagctcagggatttgcccccacccaggactggcaaattagctttactcaacatgccccgagtcagaaaactaaaatacctcttagtctaggtagacactttcactggatagttagaggcctttcctatagggtctgagaaggccaccgcagtcatttcttcccttctgtcagacacaattcctcagtttagccttcccacctctgtacagtctgctaacagaccagcctttattagtcaaatcagccaagcagtttttcaggctcttagtattcagtgaaacctttatatcccttatggtcctccgtcttcaggaaaagtagaacggactaaaggtcttttaaaaacacacctcaccaagctcagccaccaacttaaaaaggactggacaatacttttacgactttcctttctcagaagtcaggcctgtcttcagaatgctacagggcacagcccatttgagctcctgtatagatgctctttttattaggccccagtctcaccccagacaccagaccaacttagactgtgccccaaaaaacttgtcatccctactattttctgtctagtcatactcctgttcaccattctcaactactcatacatgccctgctcttgtttacattgccggtttacattgtttctccaagccatcacagctgatatctcctcgtgctatccccaaactgccactcttaactcttgaagtaaataaataatctttgctggcaaggctatgctgaacctctttaagcactctctaattagatgtcctaagtcctcccaattcttaatcctttaatacctgtatttctccttctcttattccgtttagttttcaatccataaaagccatattcaggccatcaccaataattctacatgacaaatgtttcttctaacaaccccacaatatcaccccttaccacaaaatcttccttcagcttaatctctcccactctaggttcccacgccgcccctaatcccgctcgaagcagccctgagaaacatcacccattatctctccataccacccccagaaaattttcaccgtcccaacactttaccactatttcattttatttttcttattaatataagaagacaggaatatcaggcctctgagcccaagctaagccatcatatcccctgtgacctgcacctacacatccagatggccggttcctgccttaactgatgacattccaccacaaaagaagtgaaaatggcctgttcctgctttaactgatggcattatcttgtgaaattccttctcctggctcatcctggctcaaaagctcccctactgagcaccttgggaccccccactcctgcccaccagagaacaacccccctttttcttttacctacccaaatcctataaaacggccccaccctgtctctcttcactgactctcttttcagactcagcccgcctgcacccaggtgaaataaacagctttattgctcacacaaagcctgtttggtggtctcttcacaaggacgcgagtaaaa

SEQ ID NO: 339 - DNA, 4734 bp, Homo sapiens
gtcaggcctctgagcccaagccaagccatcgcatcccctgtgacttgcacgtatatgcccagatggcctgaagtaactgaagaatcacaaaagaagtgaatacgccctgccccaccttaactgatgacattccaccacaaaagaagtgtaaatggccggtccttgccttaagtgatgacattaccttgtgaaagtccttttcctggctcatcctggctcaaaaagactcccactgagcacctttcgacccccactcctgcccgccaaagaacaacccccctttgactgtaattttcctttacctacccaaatcctatcaaacggccccaccccatcttcctttgctgactctcttttcggactcagcctgcctgcacccaggtggaataaacagccatgttgctcacacgaagcctgtttggtggtctcttcacacggacacgcatgaaatttggtgccgtgactcggatcgggggacctcccttgggagatcaatcccgtcctcctgttctttgctctgtgagaaagatccacctacgacctcaggtcctcagaccgaccagcccaaggaacatctcaccaattttaaatcaggtaagcggcctcttcttactgtcttctccaacctctctcactgtacctcaaccactttctcctttccactcttcagtctctcccttctcttaatttcaattcctttcgttttctgggagagacaaaggagacacattttatccgtggacccaaaactccagcgccggtcacggactgggaaggcagccttcccttggtgtttaatcattgcagggacgcctgattattcatccacgtttcaaaggtgtcaggccacgcagggatgcctgccttggtccttcgcccttagtggcaagtcccgcttttctggggaaggggcaagtaccccaaccccttctctccttgtctctaccccttctctgcttttctgggggaggggcaagtacccctcaaccccttctccttcactcttagcggcaagtcccgcttttctagaggggcaagtaccccaacctcgtatctctgcgccccaatcccttatttctgcgccccaacctcttatatctctgtgccccaatcccttatttccacaccccaacctcttatctctgcaccccaaccccttatttccgtgcccctaccccttatttctgtgccccaacctcttatctctgtgccccaaccccttttcccacttttctggaaggtgagagagtagagaaacggaggggaggggttcgggggttcttttttctctaggcttgcttccttcactataggcaaccttccaccctctattcctccttctactcccttggcctgtgttctcaaaaacttaaaacctcatcaactcttacctgacctaaaacctaaatgccttattttcttctgcagtgcctcttgaccccaatacaaactcaacagtagttccaaatagccagaaaatggcactttgaatttttccatcctgcaagatctaaataattcttgtcgtaaaataggcaaatggtctgaggtgcctgacgtccaggcatccttttacacatcagtcccttcctagtctctgtgcccagtgcaactcgtcccaaatcttccttctttacctcccacctgtcccctcagtaccaaccccaagcgtccctgagtctttctaatcttccttttctacagacccatctgacctctcccttcctcccaggctgcttctcgccaggccgagctaggtcccaattcttcctcagcctctgctcctccaccctataatctttttatcgcctcccctcctcacacctggtccggcttacagtttcgttccgtgactagccctccccctcctgcccagcaatttactcttaaaaaggtggctggagctaaaggcatagtcaaggttaatgctcctttttctttatccgaaatcagatagcatttaggctctttttcatcaaatataaaaatccagcccagttcatgacttgtttggcagcaaccctgagacactttacagccctagaccctaaaaggtcaaaaggcagtcttattctcaaaatacattttattacccaatctgctcccgacattaaataaaactccaaaaattaaattccggccttcaaaccccgcaacaggatttaattaacctcgccttcaaggtgtacgacaatagaaaaaagttgcaattccttgcctccactgtgagacaaaccccagccacatctccagcacacaagaacttccaaacgcctgaaccgcagcggccaggcattcctccagaacctcctcccacaggagcttgctacacctgccggaaatctggccactgggccaaggaatgcccacagcacaggattcctcctaagccgcgtcccatctgtgtgagaccccactgaaaattggactgttcaactcacctggtagccactcccagagcccctggaactctggcccaaggctctctgactgactccttcccagatcttctcggcttagcggctgaagactgacactgcccgatcgcctcggaagccccctagaccatcacggacgccgagcttcgggtaactctcacagtggaaggtgagcccatccccttcttaatcaatacggaggctacccactccacattaccttcttttcaagggcctgtttcccttgcctccataactgttgtgggtattgacggccaggcttctaaacctcttaaaactccccaactctgtgccaacttagacaatactcttttaagcactcctttttagttatccccacctgcccagttcccttattaggctgagacactttaactaaattatctgcttccctgactattcccggactacagctatatctcattgccgcccttctttcctatccaaagcctcctttgcgtcctcctcttgtatccccccaccttaacccacaagtataagatacctctactccctccttggcgaccgatcatgcaccccttaccatctcattaaaacctaatcacccttaccccactcaacgccaatatcccatcccacagcacgctttaaaaagattaaagcctgttatcactcgcctgctacagcagggccttttaaagtctataaactctccttacaattcccccattttacccgtcctaaaaccagacaagtcttacaagttagttcaggatctgcgccttatcaaccaaattgttttgcctatccaccccatggtgccaaacccatatactctcctatcctcaatacctgcctctacaacccattattctgttctagatctcaaacatgctttctttactattcctttgcacccttaatcccagcctctgttcactttcacttggactgaccctgacacccatcaagctcagcaaattacctaggctgtactgccacaaagcttcacagacagcccccattacttcaatcaagcccaaatttcttcctcatctgttacctatctcggtataattctcataaaaacacacgtgctctccctgccaatcgcgcctgaccgatctctcaaacccaagcaccttctacaaaacaacaactcctttccttcctaggcatggttagcgtggtcagaattcttacacaagagccaggaccacaccctgtagcctttctgtccaaacaacttgaccttactgttttagcctagccctcatgtctgcgtgcagcggctgccactgctttaatacttttagaggccctcaaaatcacaaactatgctcaactcactctctacagttctcataacttccaaaatctattttcttcctcatacctgacgcatacactttccgcttcccggctccttcagctatactcactcttttgttgagtccccgacaattaccgttgttcctggcccagacttcaatccggcctcccacgttattcctgataccacacctgacccccatgactgtatctctctgatccacctgacattcaccccatttccccaaatttccctctttcctgttcctcaccctgatcacgcttgatttattgatggcggttccaccaggcctaatagccacacaccagcaaaggcaggttatgctatagtacaagccactagcccacctcttagaacatctcatttcctttccatcgtggaactctatcctcaaggaaataacttctcagtgttccatctgctattctactactcctcagggattattcaggccccctcccttccctacacatcaagctcgaggatttgccccacccaggactagcaaattagctttactcaacatgccctgagtcagataactaaaatacctcttagtctaggtagatactttcactggataggtagaggcctttcctacagggtctgagaaggccaccgcagtcatttcttctgttctgtcagatataattcctcaatttagccttcccacctcaatacagtctgataacagacgagcctttattagtcaaatcagccaagcagtttttcaggctcttagtattcagtgaaacctttatatcccttacggtcctccatcttcaagaaaagtagaatggactaaaggtcttttaaaaacacaccttaccaagctcagccaccaacttaaaaaggactggacaatacttttaccactttcccttctcagaattcaggcctgtcctcggaatgctacagggtacagcccatttaagctgctgtatagacataacttggccc

SEQ ID NO: 340 - DNA, 5268 bp, Homo sapiens
tgactctctttttggactcaactcgtctgcacccaggtgaaataaacagccttgttgctcacacaaagcttgtttggtggtctcttcacatggatgcatgacacatttggtgccaaagacccaggtcagcaggactccttcaggagactgtcccctgtcctcaccctcactccatgaagagatccacctacgacctttggtcctcagaccaaccagcccaaggaacatctcacaaattttaaatcgggtaagtggcctctttttactctcttctccaacctttctcactatccctcaacctctttctcctttcattcttggtgccacccttcactccctctcttctcttaatttcaattcctttcattttctagtagagacaaaggagacacattttatccatggacccaaaactctggtgctggtcatgtactcaggaaggcagccttcccttagtgtttaatcattccggggatgcctgcctgattattcacccacattccattggcgtctgatatcttcagggatgcctgccttggtcattcaaccacattcccttggtggcaagtcaattgcggggatgcctgctttggctgctcacccacattgcagcccagggctgctccccaaccctttctccatgtctctacctttctctttaaacttgcctccttcactatgggcaaacttccaccctccattcctccttcttctcccttagcctgtgttctcaagaacttaaaatttcttcaactatcacctgaactaaaatctaaatgtcttattttcttctgcaacactgcttggccccaatacaaactcgacaatggttctaaatggccagaaaatggcacttttgatttctccatcctccgagacctagataatttttgttgaaaaatgggcaaatggtctgaggtgcctgacatccaggccttctaatacacattggtccctccctagtctctgtgcccaatgcaactcatcccaaatctttcttctttagctcctgtctgttccttcagtctccaccccaaactctgagtcctttgaatccttcttttctacagactgatctgacctctccccttctccccaggctgctcctcgccaggccaagctaggacccaattcttcctcagcctctgctcccccaccctataatctttctatcacttcccctcctcacacccaatctggcttacagtttcgttctgcaactagccctcccccacctgcccaacaatttcctgttaaagaggtggctggagctaaaggcatagtcaaggttaatgctcctttttttctttatccgacctctcccaaatcagtttttaacatcaaatataaaaactcagcccagttcatggcccatttggcaacaacccttagacgctttactgccctagacccagaggggccagaaggctatcttattctctatgcattttattacccaatctgctgctgacattagaaaaagctccaaaaattagattctggccctcaaaccccacaacaggacttaattaactgcaccttcaaggtgtatgataatagagaagagttgcaattacttgcctctgctgtgagagaaaccccagccatatctccagcacacaaaaacttcaaaatgcctaagccacagcagccaggcatcccttcaggacttcctcccccaggatcttgctttaagtgctggaagtctggccactgggccaaggaatgcctgcagcctgggattcctcctaagctgtgtcccatctgtgcgggaccccactggaaattggactgtccaactggcccaaggctctgactgtctccttcccaggtcttcttggcttagtggctgaacactgacactgccaatcacctcagaagccccctgaactgtcacggatgccgagttttgggtaacttacagtggagggtaagtctgtccccttcttaatcaatacagaggctaccaactccacactaccttcttttcaagggcctgttcccttgcctccataactgttgtgcgtattgatggccaggcttctaaacatcttaaaactccccaactctggtgccaacttggacaatattctttaatgtactcctttttagttatccccacctgcccagctcccttattaggtcaagacattttaactaaattgtctgcttccctgactattcctaggctacagccacacctcattgctgcccttttccccagttcaaaacctccttcacatcctcccttgttatctccccaccttaatccacaagtgtgggatacctctactccctcactggcaactgatcacacacccattactatcccattaaacataatcacccttatcatgccaatatcccatcccacagcacacttaaaggattaaagcctgttatcactcacctgttacagcatggccttttaaagcctataaactctccttacaattccctcattttacctgtccaaaaaccagacaagccttacaggttagttcaggatctgtgccttatcgaccaaattgtcttgcctatccactccatggtgccaaaaccatatactctcctatcctcaatgcctccctccacaactcctccataacccattattctgttctagatctcaaatatgctttctttactattcctttgcacctttcattccagcctctcttcactttcacttggactgaccctgacacccatcagcctcagcaacttaccagggctgtactgccacaaggcttcatggacagcccccattacttcagtcaagcccaaatttcttcctcatccattacctatctcagcataattcttcatgaaaacaacgtgctcccccagctgatcatgtccagccaatctcccaaaccccaaccccttctacaaaataacaacttcttcccttcctaggcatggttaggtacttccacctttggatacctagttttaccatcctgactaaaccattatataaactcacaaaaggaaacctagctgaccccatagatcctaaatccttttgccacttccctttccgttccttaaaaacagccctagaagctgcccccacactagctctctctaactcatcccaacccttttcgttacacacagccaaagtacaggactgtgcggtcaaaattcttacacaagagccaggaccacaccctgtaggctttttgtccaaacaacctgaccttactgttttaggctggccatcatgtctccatgcagcagctgctggtgccctaatacttttagagaccctcaaaatcacaaactatgctcaactcaccctctacagttctcataacttccaaaatctattttcttcctcatacctgacacatatactttctgctccctggccccttcagctgtactcactctttgttgagtccccgacagttaccattgttcctggcctggacttcagtctggcctcccacattattcctgataccacaactgtcccccatgactgtatctctctgatccacctgacattcactccatttccccgtatttccttctttcgtgttcctcaccctgatcacacttggtttattgatggcagttccaccaggcctaatctccactcaccagcaaaggaaggctatgctagagtatcttccacatctatcattgaggctaccactctgcacccctccactacctctcagcaagctgaactcattgccttaacttgagccctcactcttgcaaaggaattttgcgtcaatatttatagtgactctgaatatgccttccatatcctgcaccaccatgctgttatatggtctgaaagaggtttcctcactatgcaagggtcctccatcattaacgcctctttaataaaaactcttctcaaggccactttacttccaaaggaagctggagtcattcactgcaagcaccatcaaaaggcatcagatcccatcattcagggcaatgcttatgctgataaggtagctaaaaaagcagctagcattccaacttctatccctcacagcagcttttctccttcttatctggtcactcccacctactcccccactgaaacttccacctatcaatctcttcccacacaaggcaaatggttcttggaccaaggaaagtatctccttccagcctcacaggcccattctattctgtcgtcatttcatagcttctcccatgtaggttacaagccactagcctgactcttagaacttctcatttcctttccaccatggaaatctatccttaaggaaatcacttctcagtgttccatctgctattctactactcctcagggattgttcaggccccctcctttccctacacatcaatctcagggatttgcccccaaccaggactggcaaattgactttactcatacgccttgagtcaggaaactaaaatgcgtcttggtctgggtagacactttcactggatgggtagaggcctttcccacagggtctgaggaggccaccatggtcatttcttcccttctgtcagacataattcctcggtttggccttcccacctctatacagtccgataacagaccggcctttactagtccaatcacccaagcagtttctcaggctcttggtattcagtggtgcctggttttacctcaaactgccacccttaagtctctgtttaagtggatagaagatcttcattgacaaagtacactccaatactttcaccctgatgaagtcctattctttacttttatactcactcttattctggttcctattcttatgccaccctctacctctccccagctatctccaccacactatcaaactcactctctcctagccatttctaatccttctttaacaaacaattgctggctttgcatttctctttcctccaaaatcaccaaggccctgacttactcactgctaaaaaaaaggggaagggggactctgtatatttttaaatgaagagtgttgtttttatctaaatcaatctggcatggtataaaaaaactcaaggatagagccaaaaaactcaccaatcaagaaaacagtaacattgaatccccttggacactctaattggacatcctgggcactcccaatttctagtcattcaatatctatttttctccttcttttcttcagaccttgtgtctttcatttagtttctcaattcatacaaaaccgcatccaggacattaccaataattctatacaaaaaatcctccttctaacaactccacaatatcaccccttaccagaaaatcttccttcagcttaa

SEQ ID NO: 341 - DNA, 5642 bp, Homo sapiens
gtcaggcttctgagcccaagctaagccatcgtatcccctgtgacctgcacatacacatccagatggccggttactgccttaactgatgacattcctccaaaaaagaagtgaaaatggcctgttcctgccttaactgatgacattatcttgtgaaattccttctcctgggtcaaaagctcccttactgagcaccttgtgacccccacccctgcccgccagagaacaacccctttgactgtaattttcctttacctacccaaatcctataaaacggccccacccctatctcccttcactgactctcttttcggactcagcccgcctgcacccaggtgaaataaacagccttgttgctcacacaaagcctgtttggtggtctcttcacatggtcgcgcatgaaatttggtgccgtcactcagatcaggggacctcccttgggagatcaatcccctgtcctcctgctctttgctccatgagaaagatccacctatgacctcaggtcctcagaccgaccagcccaaggaacatctcaccaatttcaaatccagtaagcggcctctttttactctcttctccaccctctctcactatccctcaacctctttctcctttcaatcttggcaccacacttccatctctcccatctcttattttcaattcctttcattttctggtagagacaaaagagacacattttttccgtggacccaaaactccggcgccagtcacagactcaggaaggcagccttcccttggtgtttaatcattgtggggacacctctctgattattcacccacgttccactggtgtctgatctccacggagacgcctgccttgatcattcacccacgttcccttggtggcaagtcaattgcggggacgcctgctttggctgctcaaccacgttgcagcccagggctgctccccaccaccttctctgtgtctctatccttctctttaaacttgcctcctttactatgggcaaccttccaccctccattcccccttcttctcccttagcctgtgttcttaaaaacctaaaacctcttcacctcacacctgacctgaaacctaaatgccttatttttttctgcaatgctgcttgaccccaatacaaactcaacagtggttccaaatagccagaaaatggcactttcaattattccatcctacaaggtctaaataattcttgtcgtaaaatgggcaaacggtctgaaatgcctgacgtccaggcattcttttacacatcggtccctccctagtctctgttcccaatacaactcgtcccaaatcttccttctttccctcctgcctgtcccctcagtcccaaccccaagcgtcgctgagtctttctaatcttccttttctacagacccatctgacctctcccctcctcgccaggctgagctaggtcccacttcttcctcagcctccgctcctccaccctataatcattttatcacctcccttcctcacacccggtccagcttacagttttgttctgtgactagccctcccccacctgcccagcaatttactcttaaaaaggtggctggagctaaaggcgtagtcaaagttaatgctcctttttctttatcccaaatcagatagcatttagactctttctcatcaaatataaaaacccagcccagttcatggcagcaaccctgagatgctttacagccctagatcctaaaaggtcaaaaggccgtcttattctcaatatacattttattacccaatctgctcccgacatttaataaaactccaaaaattaaattccggccctcaaaccccacaacaggacttaattaaccttgccttcaaggtgtacaacaatagagtagaggcagccaagtagcaacatatttctgagttgcaattccttgcctccaccgtgagacaaaccccagccacatctccagcacacaagaacttccaaatgcctcaaccacagtggccaggcattcctccaggcctgcctcccctaggagcttgctacaagtgccagaaatctggccaccaggccaaggaatgtccacagcccaggattcctcctaagccgcgtcccatctgtgtgggaccccactgaaaatcggactgttcaactcacctggcagccactcccagagcccctggaactctggcccaaggctctctgactgactccttcccagatcttcttggcttagcggctgaagactgatgctgcccgatcgcctcagaagccccgtagaccatgatggacaccgagctttaggtaactctcacagtggaagataagtccgtccccttcttaatcaatacggaggctacccactccacgttaccttcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggccgagacactttaactaaatgatctgcttccctgactattcctggactatagctacatctcattgctgcccttcttcccaatccaaagcctcctttgtgtcctcctcttgtatccccccaccttaacccacaagtataggatacctctactccctccttggtgaccgatcatgcaccccttaccatctcattaaaacctaatcacccttaccccgctcaatgccaatatcccatcccacagcacgctttaaaaggattaaagcctgttatcactcgcctgctacagcatggccttttaaagcctataaactctccttacaattcccccattttacctgtcctagaaccagacaagccttacaggttagttcaggatctgcgccttatcaaccaaattgttttgcctatccaccccgtggtgccgaacccatacactctcctatcctcaatacctccctccacaacccattattctgttctggatctcaaacatgctttctttactattcctttgcacccttcatcccagcctgtcttcgctttcacttggactgaccctgacacccatcaggctcagcaaattacctgggctgtactgcctcaagtcttcacagacagcccccattacttcagtcaagcccaaatttcttcctcatctgttacctatctcagcgtaattctcataaaaacacacgtgctctccctgctgatcatgttcagctgatctctcaaaccccgagaactacaaaacaacaactcctttccttcctaggcatggttggatactttcgactttagatagctggttttgccatcctaacaaaaccattatataaactcacaaaaagaaacctagctgaccccatagatcctaaatcctttccccactcctctttccattccttgaagacagctttagaggctgcccccaccctagctctccctgatttatcccaacccttttcattacacacagctgaagtgcagggctgtgcagtcaggattcttacataaggaccgggatcatgtcctgtagcctttttatccaaacaacttgaccttactgttttgcccagccctcaagtctgcgtgcagcggccgccgctgccctaatacttttagaggcccttaaaatcacaaactatgctcaactcactctctgcagttctcataacttccaaaatctattttcttcctcacacctgacacatactttctgctccccggctccttcagctgtactcactctttgttaagtctcccacaattaccatcgttcctggcccggacttcaatccagcctcccacattattcctgataccacacctgacccccatgactctatctctctgatccacctgacattcaccccatttccccatatttccttcttccctgtttctcaccctgatcacacttggtttattgatggcagttccaccaggcctaatcgccacacaccagcaaaggcaggctatgctatagtacaagccactagcccacctcttagaacctctcatttcctttccatggtggaaatctatcctcaaggaaataacttctcagtgttccatctgctattctactactcctcagggattattcaggcccccttccttccctacacatcaagctcggagatttgcccccatccaggactggcagattggctttactcaacatgccccgagtcagataactaaaatacctcttagtctaagtagacattttcactggatgggtagaggcctttcctacagggtctgaggaggccaccacagtcatttcttcccttctgtcagacataattcctctgttcagccttcccacctctatccagtctgataacagaccagcctttattagtcaaatcagccaagcagtttttcaggctcttggtattcagtgaaacgtttatatcccttacagtcctcagttttcaggaaaagtagaacagactaatggtcttttaaaaacacacctcaccaagctcagccaccaacttaaaaaggaatggacgatacttttaccactttcccttctcagaattcaggcctgacctcagaatgctagaaggtacagcccatttgagctcccgtatagacgctcctttttattaggccccagtctcatcccagacaccagaccaacttagactgtgcccccaaaatcttgtcatctctactattttctgtctagtcatactcctattcaccagtttcaactactcataaatgccctgctcttgtttacactgccagtttacactgtttctccaatctatcacagctgatatctcctggtgctatccccaaaccgccactcttaaagtgaataaataatctttgctggcaaggctatgctgaacctccttaggcactctctaattagatgtcctaggtcctcccaattcttagtcctttaatacctgtttttctccttctcttgttctgtttagtttttcaattcatacaaaactgtatccaggccatcaccaataattctacacaacaaatgtttcttctaacaaccccacaatatcaccccttaccacaaaatcttccttcagcttaatctctcccactctaggttcccacgcctcccctaatcccgcttgaagcagccttgagaaacatcgcccattctctctccataccacccccaaaaattttcgccgccccaacactttaccactatttctttttatttttctcattaatataagaagacaggaatgtcaggcctctgagcccaagctaagccatcatatcccctgtgacctgcacatacacatccagatggctggttcctgccttaactgatgacattccaccacaaaagaagtgaaaatggcctgttcctgccttaactgatgacattctcttgtgaaattccttctcctggctcatcctggatcaaaagctcccctactgagcaccttgtgacccccactcctgcctgccagataacaacccctttgactgtaattttcctttatctacccaaatcctgtaaaacagccccacccctatctcccttcactgactctcttttcggactcagcccacctgcacccaggtgaaataaacagccttgttgctcacacaaagcctgtttggtggtctcttcacacggacgtgcatgaaa

SEQ ID NO: 342 - DNA, 3900 bp, Homo sapiens
tgactctctttttggactcagcccacctgcacccaggtgaaataaacagccatgttgctcacacaaagcctgtttggtggtctcttcacacggacgcgcatgaaatttggtgttgtgactcggatcgggggacctcccttgggagatcaatcccctgtcctcctgctctttgctcggtgagaaagatccacctatgacctcaggtcctcagactgaccagcccaagaaacatctcaccaatttcaaatctggtaagtggcctctttttactctcttctccaacttccctcactatccctcaacctctttctcctttcaattttggcgctacacttcaatctctcccttctcttaatttcaattcctttcattttctggtagagacaaaagagacacattttatccgtggacccaaaactccggcgccagtcacggactgggaaggcagccttcccttggtgtttaatcattggagggacgcctctctgattatacacccacgtttcaagggtgtcagaccacgcagggacgcctgccttggtccttcacccttagcggcaagtcccgcttttctggggaaggggcaagtaccccaaccccttctctccttgtctctaccccttctctgcctttcctggggcaggggcaagtacccctcaatcccttctccttcacccttagcggcaagtcccgctttcctaggggcaagaaccccccaatcgcttatttccacaccccaacctcttatctctgtgccccaatcccttatttccgcaccctgacctcttatctctgtgccccaatcccttatttctgtgccccaaccccttctctgcttttctggagggcaagaaccccccaccccttctccgtgtctctactcttttctctgggcttgcctccttcactatgggtaggcttccaccttccattcctccttctcccttagcctgtgttctcaaaaacttaaaacctcttcaactcacacctgacctaaaacctaaatgctttattttcttctgcaatgccgcttgaccccaatacaaactcgacatagttccaaatagctggaaaacggcactttcaatttttccatcctataagatctaaataattcttgtcgtaaaatgggcaaacggtctgaggtgcctgacgtccaggcattcttttacacatctgtcccttcctagtctctgtgcccagtgcaactcgttccaaatcttccttctttccctccctcctgtcccctcagtcccaaccccaagcagtgctgagtctttctaatcttctttttctacagacccatctgacctctcccctccacaccaggccaagctaggtcccaattcttcctcagcctcagcgcctccacactgtaatctttttatcgccaccccccaccccctccaccccgcatcccacacctggtcctgcttacagtttcattctgtgactagccctcccccacctgcccagcaatttactcttaaaaaggtggctggagccaaaggcctagtcagggttaatgctcctttttctttatcctgaatcagatagcgtttaggctctttttcatcaaatataaaaatccagcccacttcatggctcattcggcagcaaccctgagacgctttacagccctagaccctaaaaggtcaaaaggccgtcttattctcaatatacattttattacccaatctgctcccaacattaaataaaactccaaaaattaaattccggccctcaaaccccacaacaggatttaattaacctcaccttcaaggtgtacaataatagaaaaaagttgcaattccttgcctccactgtgagacaaaccccagccacatctccagcacacaagaacttccaaatgcctgaaccgcagcggccaggcgttcctctagaacctcctcctccaggagcttgctacaagtgccagaaatctgaccaccaaggcaaggaacgcctgcagcccaggattcctcttaagccgtatcccatctgtgcgggaccccactggaaatcggactgttcaactcacctggcagccactcccagagcccctggaactctggcccaaggctctctgactgactccttctcggcttagcggctgaagactgacactgcccgatcgcctcggaagccccgtagaccatcatggacgccgagcttcaggtaactctcacagtggaaggtaagtccgtccccttcttaatcaatacggagcctacccactccacattaccttcttttcaagggcctgtttcccttgcctccataactgttgtgggtattgacagccaggcttctaaacttcttaaaactccccaactctggtgccaacttagacaacactcttttatgcactcttttttagttatctccacctgcccacttctcttattaggccgagatattttaaccaaattatctgcttccctgactattcctggactacagccgcatctcattgctgcccttcgtcccaatccaaaacctcctttgcttcctcctcttgtattcccccaccttaacccacaagtataagagacctctactccctccttggtgactgatcacgcaccccttaccatctcattaaaacctaatcacccttaccccgctcaacgccaatatcctatcccacagcacgctttaaaaggattaaagcctgttatcactcgcctgctacagcacgggcttctaaaacctataaactctccttaccattcccccattttacctgtcctaaaaccaggcaagggttacaagttagttcagaatctgcaccttatcaaccaaattgtttttcctatcccccccgtggtgccaaagccatatactctcctatcctcaatacctccctctgctacccattattctgttctggatctcaaacatgctttctttactatcctttgcaccttcatccagcctctctttgccttcacttagactgaccctgacacccattaggctcagcaaattacctgggctgtactgccgcaaggcttcacagacagcccccattacttcagtcaagcccaaatttcatcctcatctgttacctatctcggcataattctcataaaaacacacgtgctctccctgctgatcgtgtccgattaatctcccaaacctcaatcccttacaaaagaacaactcctttccttcctaggcatggttagtgcggtcagaattcttacacaagagccaggaccacaccgtgtagcctttctgtgcaaacaacttgaccttactgttttagcctagccctcatgtctgcatgcagcggctgccgctgctttaatactgttagaggccctaaaaatcacaaactatgctcaactcactctctacatttctcataacttccaaaatctattttcttcctcatacctgacgcatatactttctgctccccggctccttcagctgtactcactcttaaatcccacaattaccattgttcctggcccggacttcaatctggcctcccacattattcctgataccacacctgacccccatgactgtatctctctgatccacctgatattcaccccatttccccatatttccttctttcctgttcctcaccctgatcacgcttgcctcgtgctatccccaaactgccattcttaactcttgaagtaaataaataatctttgctggcagggctatgctgaatctccttaggcactctctaatcagatgtcctgagttgtcccaattcttagactttttatacctgtttttctccttctgttattccatttagtttttcaattcatacaaaaccatatccaggccatcaccaataattctacacaacaaatgtttcttctaacaaccccacaatatcaccccttaccacaaaatcttccttcagcttaa

SEQ ID NO: 343 - DNA, 6087 bp, Homo sapiens
gtcagggctctgagcccaagctaagccatcatatcctctgtgacctgcacgtatacatccagatggccggttcctgccttaactgatgacattccaccacaaaagaagtgaaaatggcctgttcctgcgttaactgatgacattgtcttgtgaaattccttctcctggctcatcctggctcaaaagctcccctactgaacaccttgtgaccccccactcctgcccaccagagaacaactccctttgactgtaattttcctttacctacccaaatcttataaaacggccccacccctgtctcctttcactgactctctttttggactcagcccgcctgcacccaggtgaaataaacagccatgttgctcacacaaagcctgtttggtggtctcttcacacggacacgcatgaaatttggtgctgtgactcagatcaggggacctcctttgggagatcaatcctctgtcctcttgctctttgctctgtgtaaaagatccacctacgacctcaggtcctcagacccaccagcccaaggaacatctcaccaattttaaatcgggtaagcggcctcttcttactctcttctccaacctctctcactaaccgtcagccactttctcctttccactcttctgtctctcccttctcttaatttcaattcctttcattttctggtagagacaaaggagacacattttatctgcgaacccaaaactccggcgccggtcatgggctgggaaggcagccttcccttggtgtttaatcattgcagggatgcctctctgattattcacccatgtttcagaggtgtcagaccatgcagggatgcctgccttggtccttcacccttagcggcaagtcccattttttggggggagaggcaagtaccccaaccccttctctccatgtctctaccccttctccacctttctggggggcaagaaacccccaaccccttctccttcacccttagtggcaagtcctgcttttctgggggaggggcaagtaccccaacctcgtatctctgcaccccatcccttatttccatgccctgacctcttatatgtctgcaccctgatcccttatttccatgccccaacctcttatatctctgtgccctgatcccttatttccatgccccgacctcatatctctgtgccccaacccctttcccgcttttctggagggtaagaacccccgaaccccttccctccgtgtctctactcttacttttctttaaacttgcctccttcactataggcaaccttccatcctccattcctccttcttctcccttagcctgtgttcttaagaacataaaacctcttcaactctcaccggacctaaaacctaaatgccttattttcttctacaatgccacatgaccccaatacaaactcaacagtggttctaaatggccagaaaatggcactttcgatttctccatcctacaagatctaaataatttttgtcaaaaaataggcaaatggtctgaggtgcctgatgcccaggaactcttttacacatagtccctctctagtctctgttcccaatgcaactagtcccaaatcttccttctttccctccctcctgtcccctcagtccaaaccccaagtgtcgctgagtctttgtaatcttccttttctacagacccatctgacctctcccctcctccccaggccaagctaggtcccaattcttcctcagcctctgctcctccaccctataatctttttatcacctcccctcctcacacctggtctggcttacagtttcattccatgactagccctcccccacctgcccagcaatttactcttaaaaaggtggctggagctaaaggcatagtcaaggttaatgctcctttttctttatcccaaattagttagatttaggctctttttcatcaaatataaaaatccagcccagttcatggctcatttggcagccaccctgaaacgctttacagccctagaccctaaaaagtcaaaaggctgtcttattctcaatatacattttattacccaatctgctcctgacattaaataaaactccaaaaattaaattccagccctgaaaccccacaacaggatttaattaacctcaccttcaaggtgtacaataatagaggcagccaagtagcaacatatttctgagttgcaattccttgcctccactgtgagacaaaccccagccacatctccagcacacaagaacttccaaacgcctaaaccacagtggccaggtgttcctccagaaccaccttccccaggagcttgctataagtgccagaaatctggacaccaggccaaggaatgcccacagcccaggattcctcctaagccatgtcccatctgtgcgggaccccactggaaatcagactgttcaactcacatggcagccactcccagagcccctggaactctggcccaaggctctctgactgactccttcccagatcttcttggcttagcagctgaagactgacagtgcccgatcgcctcagaagcctacagaaccatcacggacaatctaggtaactctcacagtggaaggtaagtccgtccccttctcaatcaatatggaggctacccactccacattaccttcttttcaagggcctgtttcccttgcctccataactgctgtaggtattgatggccaggcttctaaacctcttaaaactccccaactctggtgccaacttagacaacactcttttaagcactccttttaagttatccccacctgcccagttccgttattaggccgagacactttaactaaattatctgcttccctgactattcctggactacagctacatctcattgccgcccttcttcccaatccaaagccacatttgtgtcctcctcttgtatccccccaacttaacccacaagtataagatacctctactccctccttggcaaccgatcatccaccccttaccgtctcattaaaacctaatcacccttaccccgctcaataccaatatcctatcccataccatgctttgaaaggataaaggcctgttatcactcacctgctacagcatggccttttaaagcctataaactctccttacaattcccccattttacctgtcctaaaaccagacaagccttacaagttagtttaggatctatgccttatcaaccaaattgttttgcttatccaccctgtagtgcccaacccgtacactcttttgtcctcaataccttcctccacaactcactattccgttcttgatcttaaagatggttttttcactattcccctgaacctctcgtcccagcctctctttgctttcatctggactgaccctgacacccatcagccccagcagcttacctgggctgtgctgccacaaggtttcagggacagtccttattacttcagccaagctctttctcatgatttattttctttccacccctctgcttctcaccttattcagtatattgatgaccttctttgtagcccctcctttgaatcttctcaacaagacacacttctgctccttcagcatttattctccaaaggatatcgggtatccccctccaaagctcaaatttcttctgcatccgttacctcggcataattcttcacaaaaacacacgtgctctccctgccgatcatgtctgactgatctctcaaaccccaaccccttctacaaaacaactactcctttccttcctgggcgtgattggatacttccgcctttggatacctggttttgccatcctaacaaaaccattatataaactcacaaaaggaaacctagctgaccccatagatcctaaatcctttccccactcctctttccgttccttgaagacagctttagagactgcccccactctagctctccctgactcatcccaacccttttcattacacacagccaaagtgcagggctgtgcagtcagaattcttacacaaggactgggatcgtgtcctgtaggctttttgtccaaacaacttgaccttactgttttaggctggccatcatgtctctgtgcagcggctgatgccaccctaataattttagaggcccttaaaatcacaaactatgctcaactcactctctacagctctcataatttccaaaatctattttcttcctcacacctgacgcacatactttctgctccctggctccttcagctatactcactctttgttgagtctcccacaattaccattgttcctggcccagacttcaatccagcctcccacattattccggataccacacctgaccctcataactgcaactctctgatccacctgacgttcaccacatttccccacatttctttcttccctgtttctcaccctgatcacagttggtttattgatggcagttccaccaggcctaatcaccacacaacagcaaaggcaggctatgctatagtacaagccactagcccacctcttaaaacctctcatttcctttccattgtggaaatctatcctcaaggaaataacttctcaatgttccatctgctattctactacttctcagggattattcaggccccctcccttccctacacatcaagcttgaggatttgcccccacccaggactggcaaattagctttactcaacatgccccgagtcagataactaaaatacctcttagtctaggtagacaatttcactggataagtagaggcctttcctgcaggtctgagaaggccaccacagtcatttcttcccttctgtcagacatcctcagtttagccttcccacctctatacagtctgataacggaccagcctttattagtcaaatcagccaagcattttttcaggctctcagtattcagtgaaacctttatatcccttatggtcctccgtcttcaagaaaagtagaatggactaaaggtcttttaaaaacacacctcaccaagctcagccgccaacttaaaaaggactggacaatacttttaccactttcccttctcagaattcaggcctgtcctcagaatgctacaaggtacagcccatttaagctcctgtatagacactcctttttattaggtaccagtctcattccagacaccagaccaacttaaactgtgacccaaaaaacttgtcatccctattattttctgtgtagtcatactcttattcacctgttctcaactactcgtacatgccctgctcttgtttacactgccagtttacactgtttctccaagccatcacagctgatatctcctggtgctatccccaaaccaccactcttaactcttaaagtaaataaacaatctttactggcaaggctatgctgagtctccttaggcactctctaattacatgtcctaggtcctcccaattcttggtcctttaatacctgtttttctccttctcttattccatttagtttttcaattcaaacaaaactgtatccaggccatcaccaataattctaaatgacaaatgtttcttctaacaaccccacgacatcaccacttaccacaaaatcttccttcagcttaatctctcccactctaggttcccacgccgcccctaatcctgctcaaagcagccctgagaaacatcgcccattatctctccataccaccccaaaaaaattttcaccatcccaaccctttaccactatttcattttatttttcttattaatataagaagacaggaatgtcaggcctctgagcccaagctaagccatcatatcccctgtgacctgcaggtacacacccagatggctggttcctgccttaactgatgacattccaccacaaaagaagtgaaaatggcctgtttctgccttaactgatgacattgtcttgtgaaattccttctcctggctcatcctggctcaaaatctcccccactgagtaccttgtgacccccactcctgcccgccagagaacaactccctttgactgtaattttcctttacctacccaaatcttataaaatggccccacctctatctcccttctctgactctcttttcgaactcagcccgcctgcacccaggtgaaataaacagccatgttgctcacacaaagcctgtttggtggtctcttcacacagacgtgcatgaaa

SEQ ID NO: 344 - DNA, 5648 bp, Homo sapiens
gtcaggcctctgagctaagccatcatatctcctgtgacctgcacgtatacatccagatggcctgaagtaactgaaaaatgacaaaagaagtgaaaatggcccgttcctaccttaacagatgacattaccttgtgaaattctcctggctcatcctggctcaaaagctcccccactgagcacctggtgacctccacccctgccagccagagaacaaccccctttgactgtaattttccactacctacccaaatgttataaaatggccccaccccatctccctttgctgactctcttttcggactcagcccgcctgcacccaggtgattaaaaagctttattgctcaccaggtttggtggtcttttcacatggacaggagtgaaatttggtgctgtgacttggatcgggggaccttccttgggagatcaatcccctgtcctcctgctctttgctctgtgagaaagatccacctacgacctctggtcctcagactaaccagcccaaggaacatctcaccaattttaaatccagtaagcagcctctccttactctcttctccagcctctctcactatccctcaacctctttctcctttcaatcttggtgccacacttcaatctctcccttctcttaatttcagttcctttccttttctggtagagacaaaggaaatgtgttttatccatggacccaaaactccggcgccggtcacggactccagaagacagtcttctgttggtgtttaatcacgtggggatgcctgcctgattattcacccacgtttcagaggtgtctgaccacgcagggacgcctgccttggtccttcactcttagcggcaagcaccacttttctggggggcaagcaccctctgaccccttctctctgtgtctctaccccttcgccactttccaggggggcaagtaccccccaccccttctctccatgtctctactcttctctttaaacttgcctccttcactgtgggcaaccttccaccctccattcctccttcttctcccttagcttgtgttctcaagaacttaaaacctcttcaactcttgcctgacctaaaatctaagcatcttattttcttctgcaacactgcttgaccccagtacaaactcaacagtggttccaaatagccagaaaatggaactttcgatttttctatcctacaagatctagataattcttgtcataaaatgggcaaacaatctgagatgcctgacatccaggcattttttacacatttttccctccctagtctctgttcccaatgagacttgtcccaaatcctccttctttccctcctgcctgtcccctcagtcccaaccccaagtgtcactgagtctttctaatcttccttttctacagacccatctgacctctcccctcctccccaggctgctccttgccaggccgagctaggtcccaattcttcctcagcctccactcctccaccctgtaatccttttgtcacctcccctcctcacacccggtccagcttacagtttcattctgcaaatagccctcccccacctgcccagcaatttcctcttaaaaaggtagctgtagctaaaggcatagtcaaggttaatgctcctttttgtttatctgacctttcccaaatcagttagcatctaggctctttttcacaaaatatgaaaacctagcccagttcatggcttgtttgttagcaaccctgagatgctttacagccccagacccttaaaggtcaaaaggccatcttattctcaatatacattttattacccaatctgctcctgacattaaataaaactccaaaaattaaattccggccctcaaaccccacaacaggacttaattaaccttgccttcaaggtgtataataatagagtagaggcagccaagtagcaatgtgtttctgagttgcaattccttgcctccactgtgagacaaatcccagccacatctccagcacgcaagaacttccaaacgcctgaactgctgcaaccagacgttcttccagggcctcctcccccaggaacttgcttcaagtgctgaaaatactgggccaaggaatgctcacagcctgggattcctcctaagccatgtcccatctgtatgggtccccactggaaatcagactgtccaacctggcagccactcccagaacccctggaactctgccccaaggctgtctgactgactccttcccagatctactcggcttagcggctaaagactgatgctgcccaatcacctcggaagtctacaggaccatcacagacgctttgggtaactcttacattggagggtaagtccatccccttcttaatcaatagggaggctactcacatcacattaccttcttttcaagggcctgtttcctttgcctccataactgttgtgggtattgatggccaggcttctaaacctcttaaaactccgcaactctggtgccaacttaaacaatactcttttaagcactcctttttagttgttgccacctgcccagctcccttattaagttgagacattttaactaaattgtctgcttccctgactattcctgggctacagccacacctcatggctgccttttcctccaattcaaagcctcctttgcatcctccccttgtatctcccaaccttaaaccacaagtataggatgcctctactccccccttggcgacaaatcatgcaccccttaccatcccattaaaacctaatcacccttgcctgctcaatgccaatatcccatcccacagcacgctttaaaaggattaaagcctgttatcacttgcctgttacagcatggccttttaaagcctataaactctccttatgactcccccattttacctgtccaaaaaccagacaagccttacaggttagttcaggatctgcaccttataatccaaattgtttttgcctatccaccccatggtgccaaagccatatactctcctatcctcaatacctccctccacaacccattattctgttctggatctcaaatatgctttctttactattcctttgcacccttcatcccagcctctcttcaatttcacttggactgaccctgacacccatcaggctcagcaaattacctgggcagtactgcaacaaggcttcacagacagcccccattacttcagttaagcccaaatttcttcctcatctgttacttatctcagcataattctcataaaaacacacatgctctccctgctgatcgtgtccgactaatctcccaaaccccaatctcttctataaaacaacaactcctttccttcctaggcatggttagtgcggtcagaattcttacacaagagccgggaccacaccctgtagcttttctgtccaaacaacttgaccttactcttttagcctagccctcatgtctacatgcagtggctgccgatgctttaatacttttagaggccctaaaaatcacaaactatgctcaactcactctctacatttctcataacttccaaaatctattttctttctcccacctgatgcatatactttctgctccccagctccttcagctatactcactctttgttgagtctcccgcaattaccattgttcctggcctggacttcaatctggccttccacgttattcctgataccacacctggtccccatgactgtatctctctaatccacctgacactcactccatttccctatattctttcctgttactcaccatgaacacacttggtttattgatggcagttccaccaggcctaattgccactcaccagcaaaggcaggctgtgctatagtatcttccacatgtatcattgaggctaccactctgccccatccactacctctcagcaagctgaactcattgccttaactcgggccctcactcttgcaatgggactacatgtcaatatttatactgactctaaatatgccttccatatcctgcaccaccatgctgttatatgggctgaaagaggtttcctcactacgcaagcttcgtccattattaatgtctcattaataaaaatgcttctcaaagccactttacgtccaaaggaagctgaagtcattcactgcaaaagccatcaaaaggcatcagatcccatcgctcaggacaacgcttatgctgataaggtagctaaaacttccgcctatcaatctcttcccacacaaggcaaatggttcttggaccagtgaaaatacctccttccagcctcacaggccaattctattctgttgtcatttcagaacctcttccgtgtaggttacaagccactagcctgcctcttagaacctctcatttcctttccattgtggaaatctatccacaaggaaatcacttctcagtgttccatctgctcttctactactcctcagggattgttcaggccccctcccttctctttacatcccctcccttctctgcacatcaagctcagggatttgccccgacccaggactggcaaattgactttactcatatgcctcgagtcaggaaactaaaatacctcttgatctgggtagaccctttcactggatgaatagaggcctttcccacagggtctgggaaggccaccatggtcatttcttcccttctgtcagacacaattcctcagtttggccttcccgcctctatatagtctgataacggactggtctttactagtcaaatcacccaagcagtttctcaggctcttggtattcagtagaaccttcctatcccttacggtcctcaatcttcaggaaaggtaaaacggactaatggtcttttaaaaacacacgtcaccaagctcagcctccaacttaaaaaaaggactctgtcaagaatagagctaaaaaaactcaccaagcaagcaagtaattacactgaacccccttggacactctctaattggatgtcctggatcctcccaattcttagtcctttaatacctgtttttctccttctcttattctgaccttgtgtattccatttagtttttcaattcatacaaaaccgtatccaggccatcatcagtaattctatacgataaatgtttcttctaacaaccccgcaatatcaccccttactacagaatcttccttcagcttaatctctcccactctaagttcccatgccaccccaatcccgctcgaagcagccctaagaaacattgctcattatctctccataccactccccaaaatttttgccaccccaactgtttaccactattttgttttattttttcttattaatataagaagacaggaatgtcaggcctctgagcccaagctaagccatcatatcccctgtgacctgcacgtatacatccagatggcctgaagtaactgaagaatgacaaaagaagtgaaaatggcctgttcctgccgtaactgatgacattaccttgtgaaattccttctcctggcttatcctggctcaaaagctcccctactgagcaccttgtgactcctacccctgccagtcagagaacaaccccctttgactgtaatctcccactacctacccaaatcttataaaacggctccaccccatctccctttgctgactctgttttcagactcagcccacctgcacccaggtgattaaaaagctttattgcccacacaaagcctgtttggtgttgtcttcacatggataggagtgaaa

SEQ ID NO: 345 - DNA, 5548 bp, Homo sapiens
gtcaggcctctgagcccaagccaagccatcgcaacccctgtgacttgctcgtatatgcccagacggcctgaagtaactgacgaatcacaaaagaagtgaaaaggccctgccccgcattaactgatgacattccaccattgtgatttgttcctgccccaccttaactgagtgattaaccctgtgaatttccttctcctggctcagaagctcccccactgagcactttgtgaccccctgcccctgcccaccagagaaccccctttgactgtaattttccattaccttcccaaatcctataaaacggccccacccctatctcccttcgctgactctcttttccgactcagcccgcctgcacccaggtgaaataaacagccatgttgctcacacaaagcctgtttggtggtctcttcacatggacgcgcatgaaatgtggcgcatgaaatttggtgccgtgactctgatcgggggacctcccttgggagatcaatcccccgtcctcctgctctttgctccgtgagaaagatccacctatgacctcaggtcctcagactgaccagcccaagaaacatctcaccaatttcaaatccggtaagcggcctctttttactctcttctccaacctccctatccctcaacctctttctcctttcaatcttggcgccacacttcaatctctccattctcttaatttcaattcctttcattttctggtagagacaaaggagacacgttttatccgtggacccaaaactccggcgccggtcacggactgggaaggcagccttcccttggtgtttaatcattgcagggccacctctctgattattcccccacgtttcaaaggtgtcaaaccacgcagggacacctgccttggtccttcacccttagtggcaagtcccgcttttctcggggaggggcaagtaccccaaccccttctctccgtgtctctaccccttctctgctcttctggggcaggagcaagaacccctcaaccccttcttcaccgttagtggtaagtcccacttttctagggggcaagaacccccaatcccttatttccatgccccaaccctttctctgcttttctgaagggcaagaaacccccgccccttctccgtgtctctactcttttctctgggcttgcctccttcactatgggcaagtttccaccctccattcctcctccttctcccttagcctgtattcttaagaacttataaacctcttcaactctcacctgacctaaaatctaagcgtcttattttcttctgcaatgccgcttgaccccaatacaaactccacagtagttccaaatagctggaaaacggcactttcaatgtttccatcctacaagatctaaataattctagtcgtaaaatgggcaaatggtctgaggtgcctgatgtccaggcattcttttacacatcagtcctttcctagtctctgtgcccagtgcaactcgtcccaaatcttccttctttccctcccacctgtcccctcactcccaaccccaagcattgctgagtctttctaatcttccttttctacagacccatctgacctctcccctcctcgccgggccgagctaggtcccaattcttcctcagcctccgctcctccaccctataatccttttatcacctcccctcctcacacctggtccagcttacagtttcgttctgtgactagccctcccccacctgcccagcaatttactcttaaaaaggtggctggagccaaaggcatagtcaaggttaatgctttttctttatcccaaatcagaagcgtttaggctctttttcatcaaatataaaaacacagcccagttcatggcttgttcggcagcaaccctgagatgctttacagccctagaccctaaaaggtcaaaaggccatcttattctcaatatacattttattatccaatctgctcccgacattaaataaaactccaaaaattggaatctggccctcaaaccccaaaacaggacttaattaaggtgtacaataataaaaaaaagttgcaattccttgcctccactgtgagacaaaccccagccacatctccagcacacaagaacttccaaacgcctgaaccgcagcggccaggcgttcctccagaacctcctcccccaggagcttgctacaagtgccagaaatctgaccaccaggccaaggaatgcctgcagtccaggattcctcctaagccgtgtcccatctgtgcaggaccccactggaaatcggactgttcaactcacctggcagccactcccagagcccctggaactcttgcccaaggctctctgactgactccttcttggcttagcggctgaagactgacgctgcccgattgcctcggaagccccgtagaccatcacagatgccgagctttaggtaactctcacagtggagggtaagtccgtccccttctcaatcaatacggaggctacccactccacattaccttcttttcaagggcctgtttcctttgcctccataactgttgtaggtattgacagccaggcttctaaacctcttaaaactccccaactctggtgccaacttagacaatactcttttatgcactcatttttagttatccccacctgcccagttcccttattaggccgagatattttaaccaaattatctgcttccctgactattcctggactacagctgcatctcattgccgcccttcttcccaatccaaagcctcctttgcatcctcctcttgtatccccccaccttaacccacaagtataagatacctctactccctccttggtgaccgatcatgcaccccttaccatctcattaaaagctaatcacccttacccggctcagtgccaacatcccatcccacagcatgctttgaaaggattaaagcctgttatcactcgcctgctacagcatggccttttaaagcctataaactctccttacaattcccccattttacctgtccaaaaactggaaaagccttacaggttagttcaggatctatgccttattaaccaaattgttttgcctatccaccccatggtgccaaacccatatactctcctatcctcaatacctccctccacaatccattattctgttctggatctcaaacatgctttctttcctattcctttgcacccatcttcccagcctctcttccctttcacttggactgaccctgacacccatcaggctcagcaaattacctgggctgtactgccgcaaggcttcacagacagaccccattacttcagtcaagcccaaatttcatcctcatctgttacctatctcggcataattctcgtaaaaacacatgtgctctccctgctgttcgtgtccgattaatctcccaaacctcgatcccttacaaaacaacaactccttcccttcctaggcatggttagtgcggtcagaattcttacacaagagccaggaccgcaccctgtagcctttctgtgcaaacaacttgaccttactgttttagcctagccctcatgtctgcgtgtagcggctgccactgctttaatactattagaggccctcaaaatcacaaactatgctcaactcactctctacatttctcataacttccaaaatctattttcttcctcacacctgacgcatatactttctgctccctgactccttcagctgttctcactttttgttaagtcccacaattaccattgttcctggcccggacttcaatccagcctcccacattattccggataccacacctgacccccatgactgcatctctgtgatccacctgatgttcatcccatttccccacatttccttcttccctgttcctcaccctgatcacgcttgatttattgatggcagttccaccaggcctaatcgccacacaccagcaaaggcaggctatgctatagtacaagccactagcccgcctcttagaacctttcatttcctttccattgtagaaatctatcctcaaggaaataacttctcagtgttccatctgttattctactactcctcaaggattattcaggccccctcccttccctacacatcaagcttgagcatttgccccagcccaggactggcaaattagctttactcaacatgccccgagtcacaaaaactaaaatacctcttagtctaagtagacactttcactagatagggagaggcctttcctacagggtctgagaaggccaccacagtcatttcttcccttctgtcagacataattcctcagtttagccttcccacctctatacagtctggtaacagactagcctttattagtcaaatcagccaagcattttttccagctcttagtattcagtgacagactaatggtctattaaaaacacacctcaccaagctcagccaccaacttaaaaaggactggacaatacttttaccactttcccttctcagaagtcagacctgtcctcagaatgctacaagctacagcccatttaagctcctgtatagacgctcctttttattaggccccagtctcattccagacaccagaccaacttagactgtgcccccgaataacttgtcatccctactatcttctgtctagtcatactcctattcaccgttctcaactactcatacatgccctgctcttgtttacactgccagtttacacagtttctccaagccatcacagctgatatctcctcatgctatccccaaactgccactcttaactcttgaagtaaataaataatctttgctggcaggactatgctgaatctccttaggcactctctaatcagatgtcctaggtcctcccaattcttagtccttttatacctgttttgctccttttcttattccatttagtttttcaattcatacaaaaccgtatccaggcgatcaccaatcattctatacgacaaatgtttcttctaacatccccacaatatcacccctttccacaagatctcccttcagcttaatctctcccactctaggttcccacgccgcccctaatcccgcttgaagcagccctgagaaacatcgcccattctctcttcataccaccccccaaaaattttcgccaccccaacacttcgacactattttatttttcttattaacataaggcaggaatgtcaggcctctgagcccaagccaagccatcgcatctcctgtgacttgcacgtatacacccagatggcctgaagtaactgaagaatcacaaaagtgaaaaggccctgccccgcattaactgatgacattccaccattgtgatttgttcctgccccaccttaactgagtgattaaccctgtgaatttccttctcctggctcagaagctcccccactgagcactttgtgaccccttcgcccctgcccaccagagcacaaccccctttgacagtaattttccattaccttcccaaatcctataaaatggccccatccctatctcccttcgctgactctcttttctgactcagcccgcctgcacccaggtgaaataaacagccatgttgctcacacaaagcctgtttggtggtctcttcacacggacgcgcatgaaa

SEQ ID NO: 346 - DNA, 2747 bp, Homo sapiens
taggtcaggtgcaaagtaagcccaccccactaggaactatcttgaaaaatttcaagaaaggatttaagggagattacagtgttactatgacaccaggaaaacttagaactttgtgtgaaatagactggccagcattagaagtaggttggccatcagaaggaagcctggacaggtctcttgtttcaaaggtatgacacaaggtaactggtaagccaaggcacccagaccagtttccatacatagacagttacagctggttttagacccccttccccaccacagtagttaagagaacagcagcataagcagctggcagaggcaaggaaagaccagcagagagaaaaagagaccatctataccaattctaagttaatttagactaaacaaagtcttattaatagcaaaggataattgaaatcccaaactgacaaggttttcaacaaaagtgaagtttgctaaaagttaacagtgtaacatgtattatggtaacttctaatcttgtggccttagacaatctagttcaaagacataaagaaagttcgctttaaaaaaaaaaaaaaggaatggttatcttcaaaaagaaaaaaaaaaaaggaaaaaaacggggagaggcagaatttatgtaaaaagagtgttacatggtaaattcttgtcctgaaataaattaactggttgtttaaaaaaaaaatgtaataagtcagaaagttaagacatgttgaaaaattgtctgcaaaagtcgtgaaagaaaaagttataaaaagtatttatgcaaaaaagttgtataatttaaaagtaataaggcctcctgagtactattttaaaaaaacagtttatgtgcaaggtgtataagaaaagtaaaatatacctttggtaaaaaagattataaaagggcataaaaatgtggatttttacctacattaaaaagttaaaaaaattgttttaaaagtttaagcaagttttaaaacattaattgtaaagaaaattctgtgtgtaaacatattagctaaagttaaaaaggtgtcatccagtttttctgtgaactagacattaaaaatgcaacaggtttttcttaaaggatcaacctgttctttaacaaaaattataaaaagttaaaaagagtctataaaatcttacatggtcaaacataaaaaattggataaatatgtctacaaggttttattaaaattaagtttaacattaacactaatataaaggtaaaatttaacttatgtggtataaaaatcatacaagaagcattattaaatataaaatggtgtttagctttctttggtctaaaaactaataaaaataggtgctacaggaaacattcattttactaaaggatcatagaagctaaagacttaaaacaaactttggcaattaagacagcataccaagatgcaaatgcctggttgaaatagatcaaatattccatctgcacgttaaacaaaagcaattgttatgcttgtgcacatggcaggccagaggccctgattgtcccccttccactaaggtggtcctctagtcgaccaggcataggctgcatggtagctcttttccgggactctatagcctggagtaaaaagtcatgccaagctctctctgctatatcccgaagtccctgcgggtcagcccctgagggccatccagcttccatctcccaacactaagttcacttcgtgtctgtcacagcaaggaagagacttagcattccttagagacctgaagggatgcagtgagcttaagaattttcaagagcttatcaatcagtcagcccttgttcgtcccctagcagatgtatggtagtattgtggtggacctttactaggcactctgcctaataactagagtggcacttgtgctttagtccatttggctatccctttcaccctggcatttcatcaaccagaggaaaaacaaaaaataagacatcataaagcgagagaagccccttataggtctttcaactctcacatctatttagatgcaattagagccccgcaaggaataccagatcaatttaaagcttgaaatcaaatagaggattcaagtcaatattttagtagatgacagtcaataaaaatgtagattagataaactacatctattacaaccaacagcaatgagcttttcatgagttaaaaagaaaaactcatgtcggtcccagccctgaggctacctgacctgacaaaactctttacactctatgtgtcagaaagaaaaaaaaaatggcagttggagttttaacccagactttggggccctggccaaagccagtggcctatctctcaaaacaactagacagggtttccaaaggctggcccccatgtccaagggccctggtagcaacggccctgttagcacaagaagcagataagctaactcttagacaaaacctaaagtccccccatgctgtggtgattttaataaataccaaaggacaccattagctaatgaatgctagactaactagataccaaagcttgctctgtgaaaatccccacataacgattgaagtttgcaacaccctaaccctgccatcttactcctggtatcagagagcccagttaaacataaactgtgtagaggtgttggacttagtttattctagtaggcccaacctccaagaccacccttaaacatcagtagactgggagctgtacgtggatggaagcagcttcgccaacccctgcaaagtgactctgaagaagacgacaagccctgccccagtcacacccggaagctga

SEQ ID NO: 347 - DNA, 974 bp, Homo sapiens
ggaatgggtgggggtggggggaaaagaaagagagatcagattgttactgtgtctgtatagaaagagatagacataggagactccattttgttctgtactaagaaaaattcttctgccttgagatgctgttaatctataaccttacccccaaccccgtgctctctgaaacacgtgctgtgtcaactcagggttaaatggattacgggcggtacaagatgtgctttgttaaacagatgcttgaaggcagcatactccttaagagtcatcaccactccctaatctcaagtacccagggacgcaaacactgcggaagcccgcagggacctctgcctaggaaagccaggtattgtctaaggtttctccccatgtgatagtctgaaatatggcctcttgggaagggaaagacctgaccgtcccccagcccgacacccgtaaagggtctgtgctgaggaggattagcataagaggaaggcatgcctctttgcagttgagccaagaggaaggcatctgtctcctgcccgtccctgggcaatggaatgtcttggtataaaacccgattgtatgttccatctactgagataggggaaaaccgccttagggctggaggtgggacatgcaggcaacaataccgctctgtaaggcattgagatgtttatgtgtatgcatatctaaagcacagcatttaattctttaccttgtctatgatgcagagacctttgttcacatgtttatctgctgaccttctctccactattatcctgaccctgccacatccccctctctgagaaacacccaagaatgatcaataaatactaaggaaactcagaggctggcgggatcctccatatgctgaacgctggtctcctgggcctccttatttctttctctatactttgtgtctttttcttttccaagtctctcgttccacctaacgagaaacacccacaggtgtggaggggcaacccaccccttca

SEQ ID NO: 348 - DNA, 717 bp, Homo sapiens
ttacagtaggtagctagtcaggcatgagcggggcaggagagggctccccccagtacacacacacacacacacacacacacacacacacacacacaccacgaatgtcaagtgaccatcaggtggttaactgtctctctaaaataataattggtcacagatgacaccagggaaaagcagtctcctgatagatagaaaaaaccctgaaattggtgttcagtagcttcctgataagatctcaggagttgggtgagtggactcaagcatgcgcattaagaggcaaaatggcaaaatttaactggtacatgacattctaggaacattcgactggtaagggaagaatgcctcaagtgagcgtgcatacagctccggtaaattcactgtacatgttcacctcccaagtgctagcaggtcaatgcacatgcaagcatcccaccccaagggaagaattgagaagaagggatgcaagaccccagaaatatgccaacatataaaacctcaactcaaaaggtcaaactgcatacttgatctctcaagttgccagcttggccctcttccaagtgtactttacttccttccattcctgctctaaagctttttaataaactttcacttctgctctaaaatttgcctcaggctctctttctgccttatgcccctctgtcgaattctttcttctgagaaggcaagaattgaggttgctgcagacccatacagatt

SEQ ID NO: 349 - DNA, 3725 bp, Homo sapiens
gtcaggcctctgagcccatgccaagccatcgcatcccctgtgacttgcacgtatacgcccagatggcctgaagtaactgaagaatcacaaaagaagtgaatatgccctgccccaccttaactgatgacattccaccacaacagaagtgtaaatggccggtccttgacttaactgatgacattaccttgtgaaagtccttttcctggctcatcctggctcaaaaagcacccccaccgagcaccttgcgacccccactcctgcccgccagagaacaaaccccctttgactgtaattttcctttacctacccaaatcctataaaacggcgccacccttatctcccttcgctgactctcttttcggactcagcccgcctgcacccagtgaaatacacagccatgttgctcacacaaagcctgtttggtggtctcttcacacgcacgggcatgaaatttggtgccgtgactcagattgggggacctcccttgggagatcaaccccctgtactcctgttctttgctccctgagaaagatctacctatgacctcaggtcctcagaccaaccagcccaaggaacatctcaccaattttaaatcaggtaagtggcctcttcttactctcttctccaacctctctcactgtccctcaaccactttctcctttccactcttcaatctctcccttctcttaatttcaattcctttcattttctgggagagacaaaggagacatgttttatctgtggacccaaaactccggcaccggtcacgcactgggaaggcagccttcccttggtgtttattcattgcagggatgcctctctgattatacacccacatttcaagggtgtcagaccacgcagggacgcctgccttggtccttcacctttagcggcaagtcctgcttttctggggaagggacaagtaccccaaccccttctctccttgtctctaccccttctctgcttttctgggagaggggcagtacccctcaaccccttctccttcacccttagtggcaagtcccgcttttctatggggcaagaatccccagtcccttatttccatgccccaacctcttatctctgtgccccaatcccttatttccatgccccaacctcttatctctgtgccccaatcccttatttctgcaccctgacctcttatgtctgtgccccaatcccttatttccacaccccaacctcttatctctgtgtcccaatcccttatttccgcaccccaacctctctctgtgccccaatcccttatttccatggcccaacctcgtatctctgcaccccaatcccttatttccactccccgacctcttatctctgcgctccaacccctttcccacttttctggaaggtaagaacccccgaaccccttccctccatttctctattctctcttttctctagacttgcttccttcactatgggcaaacttccaccctccattcctccttctactcccttagcctgtgttctcaaaaacttaaaacctcttcaactcacacctgacctaaaacgtaaatgccttattttcttctgcaatgccacttgaccccagtacaaactcgacagtagttccaagtagccagaaaatggcactttgaatttttccatcctgcaaaatctaaataattcttgtcgtaaaataggcaaacggtctgagatgcctgatgtccaggcattcttttacacatcagtcccttcctagtctctgtgcccagtgcaacttgtcccaaatcttccttctttccctcctgcctgtcccctcagtaccaaccccaagcgtcactgagtctttctaatcttccttttctacagacccatctgacctctcccttcctccccaggctgctcctctccaggcggagctaggtcccaattcttccacagcctctgctcctccaccctataatctttttatcaactcccctcttcacacctggtccggcttacagtttcgttccatgactagccctccccctcctgcccagcaatttactcttaaaaaggtggctggagctaaaggcatagtcaaggttaatgctcccttttctttatcccaaatcagatagtgtttaggctctttttcatcaaatataaaaatccagccccgttcatggctcgttcggcagcaaccctgagatgctttacagccctagaccctaaaaggtcaaaagggcgtcttattctcaatatacattttattacccaatctgctcccgacattaaataaaactccagaaattggaatctggccctcaaaccccacaacaggacttaattaacctcaccttcaaggtgtacaataacagaaaacagttgcaattccttgcctccactgtgagacaaaccccagccacatctccagcacacaagaacttccaaatgcctgaaccgcagtggccaggtattcctccagaacctcctcccccaggagcttgctacacatgccagaaatctggccactgggccaaggaatgcccgcagcctgggattcctcctaagccacgtcccatctgtgtgggaccccactgaaaatcggactgttcaactcacctgacagccactcccagaacccctggaactctggcccaaggctgactgactccttcccagatcttctcggcttagcggctgaagatgacactgcccaatcaccttggaagccccctagaccatcacggacgccgagcttcaggtaactctcacggtggaaggtaagcccgtccccttcttaatcaatacggaggctacccactccacattatcttcttttcaaggacctgtttcccttgcctccataactgttgtgggtattgacggccaggcttctaaacctcctaaaactccccaactctggtgccaacttagacaatactcttttaagcactcctttttcattatccccacctgcccagttcccttattaggctgagacactttaactaaattatctgcttccctgactattcctggactacagctgtatctcattgccacccttcttcccaattcaaagcctcctttgcgtcctcctcttgtatccccccaccttaacccacaagtataagatacctctactccctccttggctaccaatcatgcaccccttaccatctcattaaaacctaatcacccttaccccactcaatgccaatatcccatcccacagcacgctttaaaaagattaaacctgttatcactcgcctgctacagcatggccttttaaagcctataaactctccttacaattcccccattttacctgtcctaaaaccagacaagccttacaagttagttcaggatctgtgccttatcaaccaaattgttttgcctatcccccctgtggtgcccaacccatatactctcctatcctcaataccttcctccaccactcactattccgtgcttgatcttaaagatgcttttttcactattcccctgcacccctcgtcccagcctctcttttctttcacttggactgaccctgacacctattaggctcagcaaattacctaggctgtactgccacaaggcttcatagacagcccccattacttcagtcaagcccaaatttcatcctcatctgttacctatctcggcataattctcataaaaacatacgtgctttccctgctgatcgtgtcctattaatctcccaaacctcaatctcttacaaaacaacaactcctttccttcctaggcatagttag

SEQ ID NO: 350 - DNA, 414 bp, Homo sapiens
gtcaggcctctgagcccaagctaagccatcacatcccctgtaacctgcacgtacacatccagatgatcggttcctgccttaactgatgacattccaccacaaaagaagtgaaaatggcctgttcctgacttaactgatgacattgtcttgtgaaattccttctcctggctcatcctggctcaaaagctcccccactgagcaccttgtgatccccactctgcccgccagagaacaaaccccacccttgactgtaattttcctttacctacccaaatcctataaaatggccccacccctatctcccttcgctgactctcttttcggactcagcccacctgcactcaggtgaaataaacagccatgttgctcacacaaagcctgtttggtggtctcttcacacggacgcacatgaaa

SEQ ID NO: 351 - DNA, 363 bp, Homo sapiens
gtcaggcctctgagcccaagcctgcacttatacatccagatgtcctgaagtaactgaagaatcaggaaagaagtgaaaatggctggttcctgccttaactgatgacattaccttgtgaaattccttctcctggctcagaagctcccccactgagcaccttatgaccctcgcccctgcttgcaaaagaacaaccccctttgactgtaattttccactacctacccaaatcctataaaacagccccaccccatctcccttcactgactctctttttggactcatcccgcctgcacccaggtgattaaaaagctttactgctcacacaaagcctgtttggtggtctcttcacatggacgcacgtga

SEQ ID NO: 352 - DNA, 5913 bp, Homo sapiens
gtcagacctctgagcccaagctaagccatcatatcccctgtgacctgcacatacacatccagatggccggttcctgccttaactgatgacattccaccacaaaagaagtgaaaatggcctgttcctgccttaactgatgacattgtcttgtgaaattccttttcctggctcatcctgtctcaaaaagctcccctactgagcaccttgtgacccaccccccaactctgccctccagagaacaactcccctttgactgtaattttcctttatctacccaaatcccataaaacggccccacccttatctcccttcactgactctcttttcagactcagcccgcctgcacccaggtgaaataaacagccacgttgctcacacaaagcctgtttggtggtctcttcacacggacgcgcatgaaatttggtgccgtgactcggattgggggacctcccttgggagatcaatcccctgtcctcctgctctttgctccgtgagaaagatccacctatgacctcaggtcctcagaccgaccagcccaagaaacatctcaccaattttaaattgggtaagcagcctctttttactctctcctccaacctccctcactatccctcaacctctttctcctttcaatcttggtgccacacttcaatctctcccttctcttaatttcaattcctttcattttctggtagagacaaaggagacacgttttatctgtggacccaaaactccggcgccggtcgcagactagggaaggcagccttcgcttggtgtttaatcattgcagggatgcctctctgattattcacccaggtttcagaggtgtcagaccacgcagggacacctgccttggtccttcacccttagtggcaagtcccgcttttctggggaagggtaagtaccccaacccattctctctgtgtctctacctcttctttgcctttctggggggcaagaaacccccaaccccttctccttcacccttagcggcaagtcctgcttttctaggggaggggcaagtaccccaaccccttatatctctgcaccccgatcccttatttccacgccccaaccccttatatctctgtgccccaatcccttatttccacgccccaaccccttatatctctgctccccgatcccttatttccgtaccccaacctcttatatctctgcacccgatcccttatttccacaccccaacctcttatatctctgtgccccgatcccttatttccacaccctgacctcgtatctctgtgccccaacccctttcccacttttctggagggtaagaacccccgaaccccttccctccgtgtctctactctctcttttctctgggcttgcctccttcactatgggcaacattccaccctccattcctcctcctccttctcccttcctgtgttcttaagaacttaaaacctctttaactttcacctgacctaaaatctaagcaccttattttcttctgcaacaccacttgaccccaatacaaacttgacaatggctctaaatggccagaaaacagcactttcgatttctccatcctacaagacctaaataatttttgtggaaaaatgggcatttttcacacttcgttccctccctagtctctgttcccaatacgattcctcccaaatcctccttctttccctcccgcctgtcccctcagtcccaaccccaagcgttgctgagtctttccagtcttccttttttctacagacccatctgacctttctcctcctccccaggctgctcgtcgccaggccaagctaagtcccaattcttcctcagcctccgctcctccacactataatccttctaccacctcccctcctcacacccggtccagcttacagtttagttctgcaactaattcttccccacctgcccagcaatttcctcttagagaggtggctggagctgaaggcatagtcagggtacatgtacctttttctctatcagacctctctcagatcagtcagcatttaggctctttctcatcagaccccactaaacatatacaggaattccaatatctaactctgtcctacaatttaacctgaagtgacttaaatgtcatcctgacttctaccctctccccagatgaacaggaaagagttttttctctagcccaatttcacactgataaccgccggcttcgtgaacctgacctccaggaaggcagtagagcagttccccgagaggacccccaatggaactataaggcagattccccaggtacagctaggcgagattacatggtttcctgcctagttgaagggcttaaaaaggcagcttacaaagctgttaattatgacaagcttaaagaaactacccgaggtaaagatgaaaacccagcccaggtcgtggcccgcttagcagcaacccttacacactttaccgccctagacccagaggggccagaaggccgccttattcttaatatgcattttatcacccaatccactcctgacattaggaaaaaacttcgaaaattagaatcgggccctcaaaccccacaacaggaattaatcaacctcgccttcaaggtgtacagtaatagagaggaagcagccagacggcaacgcatttctgagttacaattacttgcctctgctgtgagacaaaacccagccacacctccagcacacaagaacttcaaaatgcctaagccgcagcagacaagcattcctacaagacttcctccatcaggatcttgcttcaagtgccagaaatctggccactgggccaaggaatgcccgcagcccaggattcctcccaagctatgtcctatctgtgcagggacccactagaaggcagactgcccagctcgcccggcagccactcctagagcccctaaagctctagcccaaggctctctgaccgactccttctcagatctgctcggcttagcgactgaagattgacgctgcccgatcacctcggaagccccccggaccatcatggacgccaagcttcaggtaactctcacagtggagggtaagtccatcccctgtttaatcgatacgggggctacccactccacgttaccttcttttcaagggcctgtttccctcaccccgataactgttgtgggtattgacggccaagcttcaaaaccccttaaaactcccccactctggtcccaacttggacaacactcttttattcactcttttttagtcatccccacctgcccagttcccttattaggctgagatattttaaccaaattatctgcttccctgactattcctggactacagccacatctcattgccacccttctccccaacccaaagcctccttcgcgtcttcctcttgtatcccaccttaatccacaagtatgggacatctctactccttacctggcaaccaatcacatgcccattaccatcccattaaaacctaatcacccttaccctgctcaatgccaatatcccatcccacagcacactttaaaaggattaaagcctgttatcactcgcctgctacagcatgggcttctaaaacctataaactctccttacaattccccattttacctgtccaaaaaccggacaagtcttacagattagttcactattcccctgcacccctcgtcccagcctctctttgctttcacttagactgaccctgacacccattaggctcagcaaattacctgggctatactgctgcaaggcttcacagacagcccccattacttcagtcaagcccaaatctcatcctcatctgttacctatctcggcataattctcataaaaacacatgtgctttccctgctgatcatgtccgattaatctcccaaacctcaatcccttacaaaacaactcctttccttcctaggcatggttagtgcagtcagaattcttacacaagagccaggaccgcaccctgtagcctttctgtgcaaacaacttgaccttactgttttagcctggccctcatgtctgcgtgcagcggctgccgctgctttaatacttttagaggccctaaaaatcacaaactatgctcagctcactctctacacctctcataacttccagaattattttctttctcacacctgacacatatactttctgctccccggctccttcagctgtactcactctttgttaagtctcccacaattaccattgttcctggcccggactccaatccggcctcccacattattcctgataccacacatgacccccatgactgtatctctctgatccacctgacattcaccccatttccccatatttccttctttcctgttcctcacccaatcatgcttgatttattgactggcggttccaccaggcctaatcgccacacaccagcaaagacaggctatgctatagtacaagccactagcccacctcttagtacctctcatttcctttccatcgtggaaatctatcctcaaggaaataacttctcagtgttccatctgctattctactactcctcagggattattcaggccccctcccttccctacacatcaagctcaaggatttgcccccacccaggactggcaaattggctttactcaacattccccgagtcagataactaaaatacctcttagtctaggtagacactttcactggataggtacaggcctttcctacagggtctgagaaggccaccgcagtcatttcttcccttctgtcagacataattcctcagtttagctttcccacctctatgcagtctgataacagacgagcctttattagtcaaatcagccaagcagtttttcaggctcttagtagtcagtgacagactaatggtctattaaaaacacacctcaccaagctcagccactaacttaaaaaggactggacaatacttttaccactttcgcttctcagaattcaggcctgtcctcggaatgctacaaggtacagcccatttaagctcctgtatagacgctcctttttattaggccccagtctcattccagataccagaccaactcagactgtgccccaaaacacttgtcatccctactatcttctgtctagtcatactcctattcactgctctcaactactcatacatgccctgctcttgtttacactgccagtttacactgtttctccaaaccatcacagctgatatctcctggtactatccccaattagatgtcctaggtcctcccaattcttagtcctttaatacctgtttttgtccttctctaattccgtttattttttaattcatacaaaactgtatccaggccatcactaataattctaaatgacaaatgtttcttctaacaaccccacaatatcaccccttaccacaaaatcttccttcagcttaatctctcctactctaggttcccacgccgcccctaatcctgctcgaagcagccctgagaaacatcgcccattctctctccataccacccccaaaacttttcgccgtcccaacactttaccactatttcattttatttttcttattaatataagaagacaggaatgtcaggcctctgagcccaagctaagccatcataccccctgtgaccttcacatacacatccagatggccggttcctgccttaactgatgacattccaccacgaaagaagtgaaaatggcctgttcctgccttaattgatgacattgtcttgtgaaattccttttcctggctcatcctgtctcaaaaagctcccctactgagcaccttgtgacccccactctgccctccagagaacaactcccctttgactgtaattttcctttatctacccaaatcctataaaatggccccaccctgatctcccttcgctgactctcttttcagactcagcccgcctgcacccaggtgaaataaacagccacgttgctcacacaaagcctgtttggtggtctcttcacatggacgcgcatgaaa

SEQ ID NO: 353 - DNA, 69 bp, Homo sapiens
ggtagttaggcatgagcaaggcaggagagggctctcccctgccacccacccactagaaatgttgggtga

SEQ ID NO: 354 - DNA, 7105 bp, Homo sapiens
gtcaggcctctgagcctaagctaagccatcatatcccctgtgacctgcacatacatatccagatggccggttcttgccttaactgatgacattccaccacaaaagaagtgaaaatggcctgttgctgccttaactgatgacattgtcttgtgaaattccttctcctggctcatcctggctcaaaagctcccccactgagcaccttgtgaccctccacgctgcctgccagaaaacaagccccctttgactgtaattttcctttatctacctaaatcctataaaacagccccacccttatctccctttgctgattctctttttggactcagcccagctgcacccatgtgaaataaacagccatattgctcacacaaagcctgtttggtagtctcttcacatggacacacatgaaatttggtgctgtgactcggattgtgggacctcccttgggagatcaatcccctgtcctcctgctctttgctctgtgaaaaagatccacctacaacctcaggtcctcagacccaacagcccaagaaacatctcaccaattttaaatcgggtaagcagcctcttcttcctctcttctccaacctctctcaccatccctcaaccactttctcctttccactcttcaatctctcccttctcttaatttcaattcctttcatgttctggtagagacaaaggagacacgttttatccgtggacccaaaactccggtgccggtcactgactgggaaggcagccttcccttggtgtttaatcattgcagggatgcctctctgattattcacccacgtttcagaggtgtcagaccactcagggacgcctgccttagtccttcacccttagcagcaagtcccgcttttctgcgggagaggcaagtaccccaaacccttctctccatgtctctaccccttctccgcgtttctagggggcaagaaacccccaaccccttctccttcacccttagcggcaagtcccgcttttctgggggaggggcaagtaccccaacctcgtatctctgtgccccgatcccttatttccatgcccccacctcttatagctctgcaccctgatcccttatttccatgtcccgacctcgtatctctgcgccccgaaccctttcccgcttttctggagggtaagaacccctgaaacgcttccttccgtgtgtctactctcccttttctttaaacttgcctccttcactataggcaaccttctaccctccattcctccttcttctcccttagcctgtgttctaaagaacataaaacctcttcaactctcgcctgacctaaaacctaaatgtcttattttcttctacaatgccacttgaccccagtacaaactcgacagtggttctaaatggccagaaaatggcactttcgatttctccatcctacaagacctaaataatttttgtcaaaaaataggcaaatggtctcaggtgcctgacgtccaggcactcttttacacatcagtcactccctagtctctcttcccaatgcaactagtcccaaatcttccttctttccctcctgcctgtcccctcagtcccaaccccaagcatcactgaccctttctaatcttccttttctacagacccatctgacctctcccctccttgccaggctgagctaggtcccaattcttcctcagcctctgctcctccaccctataatccttttatcacctcccctccttgagaggtgacagcgtgctggcagtcctcagagccctcgcttgctctcggcgcgtcctctgcctgggttcccactttggcgacacttgagcccttcagcccaccgctgcactgtgggagccccttcctgggctggccaaggccagagccagctccctcagcttgcagggaggtgtggagggataggcacgagcgggaaccggggctacacgcagtgcttgtgggccagctggagttccaggtgggcatgggcttggcgggccccgcactcggagcggccagctggccctgctggccccgggcattgaggggcttagcacccagaacagcggctgcggagggtgtactgggtcccccagcagtgccagcccaccagcgctgcactcgatttctcaccgggccttagctgccttcccgcggggcagggctcaggatctgcagcccgccatgcctgagcctcccaccccctccgtgggctcctgtgcggcctgagcctccttgacaagcgccaccccctgctccatggcgcccagtcccatcgaccatccaagggctgaggagtgcgagcgcacggcacgagactggcaggcagctccacctgcagccccagtgcgggatccactaggtgaagccagctgggctcctgagtctggtggggacgtggaaagactttatgtctagctcagggattgtaaatacgccaatcagcactctgtatctagctcaaggtttgtaaacacaccaatcagcaccctgtgtttagctcaaggtttgtgagtgcaccgatcgacactctgtatctagctgctctggtggggccttggagaacctttgtgtcgatactccgtatctaactaatctgatggggacgtggagaacctttgtatctagctcagggattgtaaatgcaccaatcagcaccctgtcaaaacaggccactgggctctaccaatcagcaggatgtgggtggggccagataagagaataaaagcaggctgcctgagccagcattggcaacccgctcgggtccccttccacactgtggaagctttgttcttttgctctttgcaataaatcttgctactgctcactctttgggtccacactgctttaatgagctgtaacactcaccgcgaagatctgcagcttcactcctgagcccagcaagaccacgagctcaccgggaggaatgaacaactccagacgcgctgccttaagagctactcaccgcaaacgtctgcagcttcactcctgagccagcgagaccacaaacccaccagaaggaagaaactccgaacacatctgaacatcagaagggacagactccagacgcgccaccttaagacgtgtaacactcaccgcgagggtccacggcttcattcttgaagtcagtgagaccaagaacccaccaattccggacacatcctcacagctggtccagtttacagttttgttccgcgactagccctcccccacctgcccagcaatttcctcttaaaaaggtggctggagcaaaaggcacagtcaaggttaatgctcctttttctttatccaacctctcccaaattagttagcattcagactctttttcatcaaatataaaaaatccagcccagttcatggctcgttcggcagcaaccctgagacgctttacagccctagaccctaaaaggtcaaaaggccatcttattctcaatatacattttattacccaatctgctcctgacattaaataaaactccaaaaaatagattctggccctcaaaccccacaacaggacttaattaacctaaccttcaaggtgtacaataatacaggcagccaagtagcaacatatttctgagttgcaattctttgcctccactgtgagacaaaccccagccacatctccagcacacaagaactccaaacgcctgaaccgcagctgccaagggttcctccagaacctcctcccccaggagcttgctacaagtgctggaaatctggccactaggccaaggaatgcccacagcccaggattcctcctaagccatgtcccatctgtgtaggaccccactgaaaattggactgttcaactcacctttcagccacttccagagtccctggaactctggcccaaagctctctgactgactccttcccagatcttctcggcttagcagctgaagactgacactgcccgatcacctcagaagcctacaggaccatcagagatactcttggtaactctcacagtggaaagtaaatccgtccccttcttaatacggaggctacccactccacattaccttattttcaaaggcctgtttctcttgcctccataactgttgtgggtattgacggccaggcttctaaacctcttaaaactccccaactctggtgccaacttagacaatactctcttaagcactcctttaattatccccacctgcccagttcccttattaggccgagacactttaactaaattatctgcttccctgactattcctggactacagcaacacctcattgccaccttttcccccagttcaaagcctccttcacatcctccctttgtatcccccgaccttaacccacaagtataagacacctctactccttccttggtgaccgatcatgcaccccttaccatcccattaaaacctaatcactcttaccccgctcaatgccaatatcccatcccacagcatgctttgaaaagattaaagcctgttatcacttgcctgttacagcatggccttttaaagcctataaactctccttacaattcccccattttagctgtcctaaaaccagacaagccttacaggttagttcaggatctgcgccttatcaaccaaattgttttgcctatccaccccgtggtgccaaacccatatactctcctatcctcaatacctccctccacaatccattattctgttctggatctcaaacatgctgtctttactattcctttgcacccttcaccccagcctctctttgctttcgcttagactgaccctgacacccattaggctcagcaaattacctgggctgtactgccgcaaggcttcacagacagcccccattacttcagtcaagcccaaatttcatcctcatctgttacctatctcggcataattctcataaaaacacacgtgctctccctactgatcgtgtccgattaatctcccgaaacctcaatcccttacaaaataactcctttccttcctaggcatggttagtgtggtcagaattcttacacaagagccagtaccgcaccctgtagcctttctgtccaaacaacttgagcttactgttttagcctagccgtcatgtctccgtggagtggctgctgccaccctaatacttttaaaggccctcaaaatcacaaactatgctcaactcgctctctacatttctcataacttccaaaatctattttcttcctcatacctgacacatatactttctgctccccggctccttcagctgtactcactctttgttaagtcccacaattaccactgttcctggcccggacttcaatccggcctcccacattattcctgataccacacctgacctccatgactctatctctctgatccacctgacattcaccccatttccccatatttccttctttcctgttcctcaccctggtcacacttgatttattgatggcagttccaccaggcctaatcgccacacaccagcaaaggcaggctatgtatagtacaagccactagcctgcctcttaaaacctctcatttcctttccatggtagaaatctatcctcaaggaaataacttctcagtgttccatctgctattctactacttatcaaggattattcaggccccctcccttccctacacatcaggcttgaggatttgcccccacccaggactggcaaattagctttactcaacatgccccgagtcagataactaaaatacctcttagtccaggtagacactttcactagataagtagaggcctttcctacagggtctgagaatgccaccgcagccatttcttcccttctgtcagacataattcctcagttgagcctttccacccctatacagtctgataacagatcagcctttattagtcaaatcagccaagcattttttcaggctcttagtattcagtgaaacctttatatcccttacagtcctcagtcttcaggaaaagtagaacagaccaatagtctattaaaaacacacctcaccaagctcagccaccaacttaaaaaagactagacaatacttttaccactttcacttctcagaattcaggcctgtcctcggaatgctacaaggtacagcccatttaagctcctgtatagatgctcctttttattaggccccagtctcattccacacaccagaccaatttagactgtgccccaaaaaacttgtcatccctactatcttctgtctagtcatactcctattcatcgttctcaactactcatacgtgccctgctcttgtttacactgccagtttacactgtttctccaagtcatcacagctgatatctcctggtgctatccccaaaccaccactctcaactcttaaagtaaataaataatctttactggcaaggctatgctgaatctccttgggcactctctaattagatgtcctaggtcctcccaattcttagtcctttaatgcctgtttttctccttctcttattctgtttagtttttcaattcatacaaaactgtatccaggccatcaccaataattctacaagacaaatgtttcttctaacaaccccacaatatcaccccttaccaaaaaatcttccttcggcttaatctctcctactgtaagttcccacgccacccctaatctcacccgaagcagccctgagaaacatcgcccattatctctccatactaccccccaaaaatttttgccgtcccaacactttaccactatttcgttttatttttcctattaatacaagaagacaggaatgtcaggcctctgagcccaagctaagccatcatatcgcctgtgacctgcacatacacatcctgatggccggttcctaccttaactgatgacattccaccacaaaagaaatgaaaatggcctgttcctgccttaactgatgacattgtcttgtgaaattccttctcctggctcattctggctcaaaagctcccctactgagcaccttgtgacccccccactctgcccgccagagaagaagccccctttgactgtaattttcctttatctacccaaatcctataaaacagccccacccttatctcccttcgctgactctcttttcggactcagcccgcctgcacccaggtgaaataaacagccatgttgctcacacaaagcctgtttggtggtctcttcacagggacgcacatgaaa

SEQ ID NO: 355 - DNA, 438 bp, Homo sapiens; identical to SEQ ID NO: 330

SEQ ID NO: 356 - DNA, 5724 bp, Homo sapiens
gtcaggcctctgagcccaagccaagccatcgcatcccctgtgacttgcacatatacgcccagatggcctgaagtaactgaagaatcacaaaagaagtgaatatgccttgccccaccttaactgatgacattccaccacaaaagaagtgtaaatggccggtccttgccttaagtgataacattaccttgtgaaagtccttttcctggctcatcctggctcaaaaagcacccccactgagcaccttgcgacccccactcctgcccgccagagaacaaaccccctttgactgtaattttcctttacctacccaaatcctataaaacggccccacccctatcttccttcactgactctcttttcggactcagcccgcctgcacccaggtgaaataaacagccatgttgctcacacaaagcctgtttggtggtctcttcacacggacgcgcatgaaatttggtaccgtgactcggatcgggggacctcccttgggagatcaatcccctgtcctcctgctctttgctccgtgagaaagatccacctatgacctcaggtcctcagaccgaccagcccaaggaacatctcaccaattttaaatcaggtaagcggcctcttcttactttcttctccaacctctctgtccctcaaccactttctcctttccactcttcaatctctcccttctcttaatttcaattcctttcattttctgggagacacaaaggagacacattttatccgtggacccaaaactccggtgccggtcacggactgggaaggcagtcttcccttggtgtttaatcattgcagggacgcctctctgattatacacccacgtttcaagggtgtcagaccacacagggacgcctgccttggtccttcacccttagcggcaagtcccgcttttctggggaaggggcaagtacctcaaccccttctctccttgtctctaccccttctctgcttttctgggagaggggcaagtacccctcaaccccttctccttcacccttagcagcaagtcctgcttttctagggggcaagaacccccaatcccttatttctgcaccccaacctcttatctctgcaccccaatcccttatttccacaccccgacctcttatctctgcgccccaaccccttttcccacttttctggaaggtaagaaccccctgaaccccttccctccatttctctactctctcttttctctaggcttgcttccttcactatgggcaaccttccaccctccattcctccttctactcccttggcctgtgttctcaaaaacttaaaacctcttcaactcacacctgacctaaaacctaaatgccttattttcttctgcaatgctgcttgaacccaatacaaacttgacagtagttccaaatagccagaaaatggcactttgaatttttccatcctgcaaaatctaaataattcttgtcataaaataggcaaatggtctgaggtgcctgacatccaggcattcttttacacatcagtcccttcctagtctctgtgcccagtgcaactcgtcccaaatcttccttctttccctcctgcctgtcccctcagtaccaaccccaagcgtcgctgagtctttctaatcttccttttctacagacccagacccatctgacctctcccttcctccccaggctgctcttcgccaggccgagctatgtcccaattcttcctcagcctctgctcctccaccctataatcttttcatcacctcccctcctcacacctggtccagcttacagtttcattccatgactagccctcccccacctgcccagcaatttactcttaaaaaggtggctggagctaaaggcatagtcaaggttaatgctcctttttctttatcccaaatcacatagcgtttaggctctttttcatcaaatataaaaatccagcccagttcatggctcgtttggcaacaaccctgagacgctttacagccctagaccctaaaaggtcaaaaggccgtcttattctcaatatacattttattacccaatctgctcccgacattaaataaaactccaaaaactggaatctggccctcaaaccccacaacaggacttaattaacctcaccttcaaggtgtacaataacagaaaaaagttgcaattccttgcctccactgtgagacaaaccccagccacatctccagcacacaagaacttccaaactcctgaaccgcagcagccaggcattcgtccagaaccccctcccccaggagcttgctacacatgccagaaatctggccactgggccaaggaatgcccgcagcccgggattcctcctaagccgcatcccatctgtgtgggaccccactgaaaatcggactgttcaactcacctggcagccactcccagaacccctggaactctggcccaaggctctctgactgcttcccagatcttcttggcttagcggctgaagactgacactgcccgatcacctcggaaaccccctagaccatcacagacgccgagcttcaggtaactctcacagtggaaggtaagcccgtccccttcttaatcaatatggaggctacccactccacattaccttcttttcaaggacctgtttcccttgcctccataactgtcgtgggtattgacggccaggcttctaaacctcttaaaactccccaactctggtgccaacttagaaaatactcttttaagcactcctttttagttatccccacctgcccagttcccttattaggctgagacactttaactaaattatctgcttccctgactattcctggactacagctatatctcattgccgcccttcttcccaatccaaagcctcctttgtgtcctcctcttgtatccccccaccttaacccacaagtataagatacctctactccctccttggtgaccgatcatgcaccctttaccatctcattaaaacctaatcacccttaccccactcaaagccaatatcccatcccgcagcacgctttaaaaagattaaagcttgttatcactcacctgctacagcatggccttttaaagcctataaactctccgcacaattcccccatgttacctgtcctaaaaccagacaagccttacaagttagttcaggatctccatcttatcaaccaaattgttttgcctatccaccctgtggtgcccaacccgtacactcttttgtcctcaataccttcctccacaactcactattccatgcttgatcttaaagatgcttttttcactattcccctgcacccctcatcccagcctctcttctttcacttagactgaccctgacacccattaggctcagcaaatttcctaggctgtactgccgcaaggcttcacaggcagcccccattacttcagtcaagcccaaatttcatcctcatctgttacctatctcggcataattctcataaaaacatacgtgctttccctgctgatcgtgtccgattaatctcccaaacctcaatcccttacaaaacaacaactcctttccttcctaggcatagtgtggtcagaattcttacacaagagccaggaccacaccctgtagcctttctgtgcaaagaacttgaccttactgttttagcctagccctcatgtctgcgtgcagcggctgccgctgctttaatacttttagaggccctcaaaatcacagactatgctcaactcactctctacacttctcataacttccaaaatctattttcttcctcatacctgatgcatatactttctgctccctggctccttcagctgtactcactctttaagtcccacaattaccattgttcctggcctggacttcagtctggccttgcacattattcctgataccacacctgacccccatgactgtatctttctgatccacctgatattcaccccatttccccatatttccttcttctttcctgttcctcaccctgatcatgcttgatttattgatagcggttccaccaggcctaatcgccacacaccagcaaaggcaggttatactatagtacaagccactagccccccgcctcttagaacctctcatttcctttccatcgtggaagtctatcctcaaggaaataacttctcagtgttccatctgctattctactactcctcagggattattcaggccccctcccttccctacacatcaagctccaggatttgccccacccaggactggcaaattagctttactcaacatgcccaagtcaggaaactaaaatacctcttagtctaggtagacattttcactggataggtagaggcctttcctacagggtctgagaaggccaccgcagtcatttcttccgttctgtcagacataattcctcagtttagccttcccacctcaatacagtctgataacagataagcctttattagtcaaatcagccaagcagtttttcaggctcttagtattcagtgaaacctttatatcccttacggtcctccgtcttcaagaaaagtagaatggactaaaggccttttaaaaacacacctcaccaagctcagccaccaaaaaggactggacaatacttttaccactttcccttctcagaattcaggcctgtcctcggaatgctacagggtacagcccatttaagcccctgtatagacgctcctttttattaggccccagtctcattccagacaccagaccaacttagacagtgccccaaaaaacttgtcatccctactatcttctgtctagtcatactcctattcaccgttctcaactactcatacatgccctgctcttgtttacactgccagtttacactgtttttccaagccatcacagctgatatctcccggtgctatcgccaaactgccactcttaactcttgaactaaataaataatctttgctggcaggactatgctgaatctccttaggcactctctaatcagatgccctaggtcctcccaattcttagaccttttatacctgtctttctccttctgttattccatttagtttctcaattcatccaaaaccgtatccaggccatcaccaatcattctatacgacaaatgtttcttctaacatccccacagtatcaccacttacctcaaggcctcccttcagcttaatctctcccactctaggttcccacgccgcccctaaccccactcgaagcagccctgagaaacatcgcccattctctctccataccaccccccaaaaattttcgctgccccaacacttcaacactattttgttttatttttcttattaatataagaaggcaggaatgtcggacctctgagcccaagccaagccatcgcatcccctgtgacttgcacatatacgcccagatggcctgaagtaactgaagaatcacaaaagaagtgaatatgccttgccccaccttaactaatgacattccaccacaaaagaagtgtaaatggccggtccttgccttaagtgataacattaccttgtgaaagtccttttcctggcttatcctggctcaaaaagcacccccactgagcaccttgcgacccccccactcctgcccaccagagaacaaccctcctttgactgtaattttcctttacctacccacatcctataaaacagccccacccctatctccgttcgctgactctcttttcggactcagcccgcctgcacccaggtgaaataaacagccatgttgctcacacaaagcctgtttggtggtctcttcacacggacacgcatgaaa

SEQ ID NO: 357 - DNA, 4488 bp, Homo sapiens
acttggataggggagcctccactgggagatcaatcccctgtcctcctgctgtttgctccatgagaaagatccacctatgaccttgggtcctcagaccaaccagcccaaggaacttctcacattttaaatcgggtaagcagcctctttttactctcttctccaacctctgtcactatccctcaacctctttctcctttcaattttggtgccacccttcaatctctcccttctcttaatttcagttcctttccttttctggtagagacagaggagatatgttttatccatgaacccaaaactccagtgccagtcacgaacttgggaagacagtcttcccttcatgtttaatcactgtggtgacgcctgcctgattattcacccacatttcagaggtgtctgatcaccgcagggatgcttgccttgatctttcaccttggtagcaagcaccacctccccaggggggcaagtaccaccaccaaccacttctctccgtgtctctaccctctcttttctctggcttgcctccttcactatgggcaactttccaccctccattcctcctgtttctcccttatcctgtgttctcaagcacttaaaacctcttcaactcacacctgacctaaaacctaaatgccttattttcttctgcaatactgcttgaccccaatacaaactcaacaatggttccaaataaccagaaaatggcactttcaatttctccatcctacaagatctagataattcttgtcgtaaaatgggcacatggtctgagatgcctgatatccaggcattcttttacacatcagtcccaccctagtctctgttcccaatgtgacccatcccaaatcctcctttccctcccctctgtcccctcagtcccaaccccaaacgctgctaagtcttttctatcttccttttctaccgacccatctgacctctcccctcctccctagactgctccacctcagatcgcaccctgccaggctgaatcaggctccaattcttcctcagcctccgctcctccatcctataatccttctatcacctcccctcctcacacccagtctggcttacagtttcattccgtgactagccctcccccacctgcccaacaatttcctcttaaagaggtggctggagctaaaggcatagtcaaggttaatgctcctttttctttatccaacctctcccaaatcagttagcatttaggctctttttcatcaaatataaaaacccaacccagtccatggcttgtttggcaacaacccttagacgctttacagccttggacccagagggaccagaaggctgtcttattctcaacatgcattttattacctaatctgctccagacattaaatacaacttcaaaaattagaatccagacctcaaaccccccccacaacaggaattaatcatccttgccttcaaggtgtacaataatagagaggaggcagctagacagtaatgcatttctgagttacaattacttgcctctgctgtgagaaaaaacccagccatacctccagcacacaagaacttcaaaatccctaagccacacatgcctaagctgcagtggtcaagcattcctacaggacctcctccatcaggatcttgcttcaagggccagaaatctggccactgggccaaggaatgctcacagcccaggattcctcccaagcagtgtcccatctgtgcagggacccactggaaatcagactgcccagctcacccagcagccactcctagagcccctaaagctctggcccaaagttctctgactgactgactccttcccagatctgctcagcttagtggctgaagacttacactgcccaatcacctcgaaagccccctggaccatcacgcatgcctagcttcaggtaactctcacagtggagggtaagtccgtcccctgcttaattgatatgggggctaccctctccacattaccttcttttcaaggggctgtttcccttgcccccataactgttgtgggtattgacggccaagcttcaaaatcccttaaaactcccccactcttgtgccaacttggacaacattcttttatgcactcttttttagttatccctacctgccctgttcccttattaggctgagacattttaaccaaattatctgcttccctgactattcctggactacagccacagctcattgccacccttcttcccaacccaaagcctcctttgcatcttcctctcatatcccactaccttaacccacagatatgggacacctctactccctccctggcaaccaatcacacacccattactaacccattaaaacctaatcacccttaccccactcaatgccaatattccatcccacagcaggctttaaaaggattaaatcctgttatcaattgcctgttacagcatggcctcctaaagcctataaactctctttacaattcccccattttacctgtccaaaaactggacaagtcctacgggtaagttcaggatctccaccttatcaaccaaattgttttgcctatccaccctgtggtgcccaaccggtacactcttttgtcctcaatacctccctccacaactcactattccattcttgatcttaaaggtgctttttccattattcccctacacccctcatcccagcccctctttgcttttacttggactgaccctgacacccatcagtctcaacaacatacctaggctgtattgctgcaaggcttcaggaacagcccccattacttcagtcaagccctttctcatgatttactttctttccgtccgtctgcttctcaccttattgaatattttgacaaccttctactttatagcccctcctacaaatcttcccaacaggacaccctcctgctcctccaacatctattctcaaaagaatattgcgtatctccctccaaagcccaaatttcttcctcatccattacctatctcagcataattcttaataaaaacacacgtggtctccctgctgatcatgtccggctaatctcccaaaccccaaccccttctacaaagtaacagctgctttccttcctaggcatggtcaggtactttcacctttggatacctggttttgccaacctgactaaaccattacataaactcacaaagtaaacctagctgaccccatagatcctaaatcctttcaccattcttctttccattccttaaaaacagccctaaaatctgctcccaccctagatctccctaactcatcccaacgcttttcattacacacagacaaagtgcagggctgtgcggtcaaaattcctacacaagagctgggaccgcaccctgtagcctttctgtccaaacaacttgacattactgttttaggctggcccccacattattcctaataccacacctgacccccacggctgtatctctctgatccacctgacattcactccatttccccatatttccttctttcctgttcctcaccctgatcacacttggtttactaatggcagttccaccaggcctaatctccactcaccagcataggcaggttatgctatagtatctttcacatctatcattgaggctaccattctgtccccatccactacctctcagcaagccaaactcattgccttaactcaggccctcactcttgcaaaaggactacacgtcaatattcatactgactctaaatatgcctcctatatcctacaccaccatgctgttatatgggctgaaagaggtttcctcactacgcaaggatcctctatcattaatgcctctttaataaaaactcttctcaaggctgctttacttccaaaggaagctggagtcattcactgcaagggccatcaaaagacatcagatcccattgctcaggccaatgcttatgctgataaggtagctaaagaagcacctagcgttccaacttctgtccctcactgccagtttttctccttctctttggtcactcccacctactcccccactgaaacttccaccaatcgatctcttcccatacaaggcaaatggttcttagaccaaggaaaatatctccttccagcctcacaggctcattctattctgtcatcatttcataacctcttccatgtaggttataagccactagcctgtctcttagaacctctcatttcctttccatcatggaaatctatcctcaaggaaatcacttctcagtgttctatctgctagtctactactccccagggattgttcaggccccctcccttccctagacatcaagctcagagatttgcccctgcccaggattggcaaattgactttactcacatgcccacagtcaggaaactaaaatacttaaaatagattttccactacctatccaaatcctataaaactgccccacccctatctccctttactctcttttcagactcagcctgtctgcagctaggtgattaaaaagctttatttctcacacaaagtctgtttggtggtctcttcacacagacacaggtga

SEQ ID NO: 358 - DNA, 764 bp, Homo sapiens
gagagacaggactagctggatttcctaggccgactaagaattccaaagcctagctggggaaggtgactgcacccacctttaaacacagggcttgtaactcagctcacacccaactaatcagatagcaaagagagctcactaaaataccaattaggctaagagcaggaggtaaagaaataatcaaatcatctatcgcctgagagcacagggggagggaaaatgattgggatataaacccaggcattcaagcccccagtggcaacggcctttgggtcccttctcgtcgtatgggagctctgttttcactcaattaaatcttgcaactgcacactcttctagtccgtgtttgaaccggctggagctgagctttcactcgctgcccaccactgctgatcgctgccatcgcagacccgtgctgacttccacccctcagggttcggtagggtgtccgctggcttctgatccagccaggcgctgcccattgctgctcccaattgggctagaggctcgccattgttcctgggtggctaagtgcctgggttcgtcctaatcgagctgaacactagtcgctgggttccacagttctcttccatgacccacggcttctaatagagctataacactcaccgcatggcccaaggttccatgccttggaatctgtgaggccaagaaccccaggtcagagaacaaaaggcttgccgccatcttgggagcagcctgccccatattgggagctctaagaacaaagacccacaggtaacact

SEQ ID NO: 359 - DNA, 356 bp, Homo sapiens
ccacagaagaagtaaaaaatagtcagttcctgccttaactgatgacattccaccattgtgatttgttcctgtcccaccctaactgatcaattgaccttgtgacattccttctcctggacaatgagtctcagaagctccccatggagcaccttgtgaccgccgcccctggccgcaagccaacaactttctttaactgtaattttccactacctacccaaatcctataaaactgccccaccccatctccctttgctgactcctttttttggactcagcccgcctgcacccaggtgattaaaaagctttattgcgcacacaaagcctgtttgatggtctcttcacccctacgcgcgtaa

SEQ ID NO: 360 - DNA, 6312 bp, Homo sapiens
gtcaggcctctgagcccaagccaagccatcgcatcccctgtgacttgcacgtgtatgcccagatggcctgaagtaactgaagaatcacaaaagaagtgaaaatgccctgccccaccttaactgatgacattccaccacaaaagaagtgtaaatggccggtccttgccttaagtgatgacattaccttgtgaaagtccttttcctggctcatcctgaggcaaaaagcttccccacggagcaccttgcgacccccactcctgtccaccagagaacaaacctcctttgactgtaattttcctttacctaaccaaatcttataaaacggccccacccctatctcccttcgctgactcttttggactcagcccacctgcacccaggtgaaataaacagccatgttgctcacacaaagcctgtttggtggtctcttcacacggacgctcatgaaatttggtgccatgactcggaccggggaacctcccttaggaaatcaatcccctgtcctcctgctctttgctccatgataaaggtccacctatgacctcaggtcctcagaccaaccagcccaagaaacatctcaccaatttcaaatccagtaagtggcctctttttactctcttctccaacctccctcactatcactcaacctctttctcctttcaatcttggcaccacacttcaatctctcccttctcttaatttcaattcctttcattttctggtagagacaaaggagacacgttttatccgtggatccaaaactccggcgccggtcacagactagggaaggcagccttcccttggtgtttaatcattgcagggacgcctctctgactattcacccaggtttcagaggtgtcagaccactcatggacgcctgccttggtctttcacccttagtggcaagtcctgcttttctgggggaggggtaagtaccccaaccccttctctccatgtctctaccccttttttgcttttctgaggcaggggcaagaacccctcaaccccttctccttcacgcttagtggtaagtcccgcttttctagggggcaagaacccccaatcccttatttccacgccccgacctcttatctctgtaccccaatcccttatttccatgccccaacctcttatctctgcaccccgatcccttatttccatggcccgacctcttacctctacaccccaatcccttatttctgcaccccgacctcttatctctgcgccccatcccttatttccatgccccgacctcttatctctgcacctcaaccccttatttccacgatccgacccctttcccgcttttctggagggtaagaacccccgaaccccttccctccttgtctctactctctcttttctctgggctttcctccttcactacgggcaaccttccaccctccattcctccatctcccttagcctgtgctctcaagaacttaaaacctcttcagctcacacctgacataaaacctaaatgccttattttcttctgcaatgccgcttgaccccaatacaaactcgacagtagttccaaatagccagaaaatggcactttcaatttttccatcctgcaagatctaaataattcttgtcataaaatagcaaacagtctgatgtgcctgacgtccaggcattcttttacacatcagtcccttcctagtctctgtgcccagtgcaactcgtcccaaaccttccttctttccctcccgcctgtcccctcagtcccaaccccaagcgtcactgagtctttctaatcttccttttctacagacccatctgacctctcccctcctccctgggctgctcctcgccgggctgagctaggtcccaattcttcctcagcctccactcctccaccctataatccttttatcacctcccctcctcacaccccgtccggtttacagtttcattccgtgagtagccctcccccatctgcccagcaatttactcttaaaaaggtggctggagctaaaggcatagtcaaggttaatgctcctttttctttatcccaaatcagatagcgtttaggctctttttcatcaaatataaaaacccagcccagttcacggctcgtttggcagcaaccccgagacgctttacagccctagaccctaaaaagtcagaaggccgtctattctcaatatacattttattaccctatctgctcccaaaaattaaataaaaatccaaaattaaatccaaatccaaataaataaaatccaataaataaaaatccaaaaattaaattccagccctcaaacccaacaggacttaattaacctcgccttcaaggtgtacaataatagaggcagccaagtagcaacatattcctgagttgcaattccttgcctccactgtgagacaaaccccagccacatctccagcacacaagaacttccaaatgcctaaaccgcagtggccaggcgttcctccagaaccaccttccccaggagcttgctacaagtgccagaaatctggccaccaggccaaggaatgcccgcagcccgagattccccctaagctgtgtcccatctgtgcgggaccccactggaaactggactgttcaactcacctggcagccactcccagagcccctggaactctggtccaaggctctctgactgactccttcccagatcttcttggcttagcaactgaagattgacgctgcccgatcaccttggaagccccctggaccatcaccaacgccaagctttaggtaactctcacagtggagggtaagtccatcccctgtttaatcgatacgggggctacccactccacgttgccttcttttcaagggcctgtttccctcgccccaataactgttgtgggtattgacagccaagcttcaaaacccctgaaaactcccccactctggtgccaacttggacaacactcttttatacactcttttttagttatcctcacctgccccgttcccttattaggccgagatattttaaccaaattatctgcttccctgactattcctggactacagccacatctcattgccgcccttctccccaacccaaagcctccttcgcatcttcctctcatatccccccaccttaacccacaagtatgggacatctctactccttccctggcaaccgatcacatgcccattaccatcccattaaaacctaatcacccttaccccgctcaatgccaatatcccatcccacagcacgctttaaaaggattaaagcctgttatcactcacctgctacagcatgggcttctaaaacctataaactctccttacaattcccccattttacctgtccaaaaaccggacaagtcttacagattagttcaggatctgcgccttatcaaccaaattgttttgcctatccaccctgtggtgcccaacccgtacattcttttgtcctcaatacctccctccacaactcactattccgttcttgatcttaaagatgcttttttcactattcccctgcacccctcatcccagcctctctttgctttcacctggattgaccctgacacccatcagtcccagcagcttacctgggctgtgctgcctcaaggtttcagggacagccctcattacttcagccaagctctttctcatgatttactttatttccacccctctgcttctcaccttattcaatatattgatgaccttctttgtagcccctcctttgaatcttctcaacaagacacacttctgctccttcagcatttattctccaaaggatatcgggtatccccctccaaagctcaaatttcttctccatctgttacctatctcggcataattcttcataaaaacacctgtgctctccctgccgctcatgtccaactaatctctcaaaccccaacccttctacaaaacaaccccttccttcctgggcatggttggatactttcacctttagacacctggttttgccatcctaacaaaaccattatataaactcacaaaaggaaacctagttgaccccatagatcctaaatcctttccccactcctctttctgttccttgaagacaactttagaaactgccccctctctagctctccctgactcatcccaacccttttcattacacacagctgaagtgcagggctgtgcagtaggaattcttacacaaggaccgggatcgcatcgtgtagcctttttgtccaaactacttgaccttactgttttaggcttgccatcatgtctctgtgcagcagctgctgctgccctaatacttttagaggcccttaaaatcacaaactatgctcaactcactctctacagctctcataatttccaaaatctatgttcttcctcacacctgacgcatatactttctgctctccggctccttcagctgtactcactctttgttgagtctcccacaatcaccattgttcctggccccaacttcaatctggcctcccacattattccggataccacacctgcccctcatgactgtatctctctgatccacctgacgttcaccccatttccccacatttccttcttctctgttcctcaccctgatcacacttagtttattgatggaagttccaccaggcctaatcgccacacaccagcaaaggcaggctatgctatagtacaagccactagcccgcctcttagaacctgtcatttcctttccatcctggaaatctcaaggaaataacttctcagtgttccatctgctattctactactcctcagggattattcaggccccctcccttccctacacatgaagctcagggatttgcccccacccaggactggcaaattagctttactcaacatgccctgagtcaggcaactaaaatacctcttagtctaaatagacactttcactgaataagtaaagacatttcctacagggtctgagaaggccaccgtagtcatttcttcccttctgtcagacacaattcctcagtttggccttcccacctctatacagtccaatagcagaccagcctttattggtcaaatcagccaagcagtttttcaggctcttagtattcagtgaaacctttatatcccttacagttctcagtcttcaggaaaagtagaacagactaatggtcttttaaaaacacacctcaccaagcccagccaccaacttaaaaaggactggacaatacttttaccactttcccttctcagaagtcagacctgtcctcagaatgctacagggtacagcccatttgagctcctgtatagacgctcctttttattaggccccagtctcattccagacaccagaccaacttagaccgtgcccccccccaaaaaaacttgtcaaccctactatcttctgtctagtcatattcctattcaccgttctcaactactcatacatgccctgctcttgtttacactgccagtttacactgtttctccaagccatcacagctgatatctcctggtgctatccccaaactgctactcttaactcttgaagtaaataaataatctttgctggcaggactatgctgaatctccttaggcactctctaatcagatgtcctgggtcctcccaattcttagaccttttatacctgtttttctccttctcttattccatttagtttttcaattcatacaaaactgtatccaggccatcaccaataattctacacaacaaatgtttcttctaacaaccccacaatatcaccccttaccacgaaatcatccttcagcttaatctctcccactctaggttcccacaccgcccctcatcccactcgaagcagccctgagaaacattgcccattatctctccataccaccccccccaaaatttttgccgcccccacacttcaacactattttatttttcttattattataagaaggcaggaatgtcaggcctctgagcccaagccaagccatcgcatcccctgtgacttgcacgtatatgcccagatggcctgaagtaactgaagaatcacaaaagtgaaaatgccctgccccaccttaactgatgacattccaccacaaaagaagtgtacatggcctgtccttgccttaagtgatgacattaccttgtgaaagtccttttcctggctcatcctggctcaaaaagcacctccactgagcaccttgcgacccccactcctgcccgccagagaacaaaccccctttgtaattttcctttacctacccaaatcttataaaatggccccacccctatctccctttgctgactctctttttggactcagcccgcctgcacccaggtgaaataaacagccatgttgctcacacaaagcctgtttggtggtctcttcacgcggacgctcatgaaa

SEQ ID NO: 361 - DNA, 972 bp, Homo sapiens
gtggggaaaagaaagagagatcagattgttactgtgtctgtgtaggaagaagtagacataagagactccattttgttcggtactaagaaaaattcttttgccttgagacgctgttaatctgtaaccctacccccaaccctgtgctccctaagacatgggctgtgtcaactcagggttaaatggattaagggctgttcagggtgtgctttgttaaacaaatgcttgaaggcagcatgcttgttaagagtcatcaccactccctaatctcaagtacccagaggcacactacactgcggaagactgcagggtcctctgcctaggaaagccaggtattgtccaaggtttctccccatgtgatagtctgaaatacagcctcgtgggaagggaaagacctgactgtcccccagccagacacccgtaaagggtctgtgctgaggaggattagtaaaagaggaaggaaggcctctttgcagttgagataagaggaaggcatctgtctcctgctcgtccctgggcaatggaatgtctcggtgtaaagcccgattgtatattccatttactgagataggagaaaaccgccttaggactggaggtgggacatgctggcagcaatactgctctttaaggcattgagatgtttctgtatatgcacatcaaaagcacagcacttttttctttaccttgtttatgatgcagagacatttgttaacgtgtttacctgctgatcttctctccactattatcctattgtcctgccacatccccctctctggaaatgcccgataatgatcaataaatactaagggaactcagaggccagtgccagcatgggtcctccgtatgctgaacgccggtcccctgggcccatttttctttctctgtactttgtctctgtgtctctttcttttccaagtctctccttccacctaatgagaaacgcccacaggtgtggaggggcaacccatcccttca

SEQ ID NO: 362 - DNA, 781 bp, Homo sapiens
gagagacaggactagctggattacctaggctgactaagaatccctaagcctagctgggaaggtaactgcatccacctttaaatacagggcttgcaacttagctcacacccaaccaatcaggtagtaaagagagctcactaaaatgctaattaggcaaaaacaggaggtaaagaaatagccaatcatctatcacctgagagcacagcaggagggacaatgatccggatataaacccagacattcgagcctgcaatggctaccctctttgggtcccctccctttgtatgggagctctgttttcactctattaaatcttgcagctgcactcttctggtccatgtttgttacagctggagctgagctttcacttgccgcctaccactgctgtttgctgccatcgcggacctgctgctgacttccatccctccggatccaacagggtgtctgctgtgctcctgatccagcgagatgcccattgccgctccccacagggctaaaggcttgccattgttcctgcatggctaagtgcctgggttcatcctaatcaggctgaacactagtcaccgggttccatggttctcttccatgacccatggcttctaacagagctataacactcacagcatggcccaagattccattcctcggaatctgtgaggccaagaaccccaggtcagagaaaacgaggcttgccgccatcttggaagtggcctgccaccattttggaagtggcctgccaccatcttgggagctctgggagcaaggaccccctggtaatatt

SEQ ID NO: 363 - DNA, 428 bp, Homo sapiens
gtcaggcctctgagcccaagctaagccatcatatcccctgtgacctgcatgtatacatccagatggcctgaagcaagtgaagaatcacaaaagaagtgaaaatggttggttcctgccttaactgatgacattccaccattgtgatttgtttctgtcccaccttaactgagcgattaacctagtgaaattccttctcctggctcagaagctccccaactgagcaccttgtgacccccgcccctgccagcaagagaacaaccccctttgactgtaattttccactacccacccaaatcctatgaaacggccccacccctatctccctttgctgactctcttttcggactcagctcacctgtacccaggtgaaataacagccttgttgctcacacaaagcctgtttggtggtctctccgcacgcacgcatg

SEQ ID NO: 364 - DNA, 3310 bp, Homo sapiens
gtcaggcctctaagcccaagctaagccatcatatcccctgtgacctgcacgtacacatccagatggccagttcctgccttaactgatgacattccaccacaaaagaagtgaaaatggcctgttcctgccttaactgatgatattatcttgagaaattccttctcctggctcatcctggctcaaaagctcccctactgagcaccttgtgacccccactcctgcccgccagagaacccccctttgactgtaattttcctttacctacccaaatcttataaaacggccccaccccatcttccttcgctgactcccttttcggactcagcccgcctgcacccaggtgattaaaagctttattgctcacacaaagcctgtttggtggtctcttcacacggacgcacatgaaatttggtgctgtgactcggatcgggggacctcccttgggagatcaatcccctgtcctcctgctctttgctccgtgaaaaagatccacctatgacctcaggtcctcagacccaccagcccaaggaacatctcaccaattttaaatcaggtaagcagcctctttttactctcttctccaacctccctcactattcctcaacctttctcctctcaatcttgatgccacacttcaatctctgccttctcttaatttcaattcttttcattttctggtagagacaaaggagacacgttttatctatggacctaaaactctggcgccggtcatggactgggaaggcagccttcccttggtgtttaatcattgcagggacgcctgattattcacccacgtttcagaggtgtcagaccacgcagggacgcctgccttggtccttcaccctttgaggcaagtcccactttcctggaggagggacaagaaccccaacctcttatctctgtgccccatcccttttttccgtgccctgaccccttttccacttttctggagggtaagaatcccccaccccttctccgtgtctctactctcctttctctgggcttgcctccttcactatgggcaagcttccaccttccattcctccttcttctcccttagcccgtgttcttaagaacttaaaacctcttcaactcactcctgacctaaaacctaaatgccttattttcttctgcaatgccgcttgaccccaatacaaactcgacagtagttccaaatagccggaaaacggcactttcaatttttccatcctacaagatctaaataattcttgtcgtaaaataggcaaatggtctgaggtgcctgatgtccaggcattcttttacacatcggtccctccctagtctctgttcccaatgtgactcgtcccaaatcttccttctttccctcccacctgtccccagtcccaaccccaagcgtcgctgagtctgtctaatcttccttttctacagacccatctgacctctcccctcaccaggccaagcgaggtctcaattcttcctcagcctccgctcctccaccctataatccttttatcccctcccctcctcacacccagtccagcttatagtttcgttccgtgactagccctccccaacctgcccagcaatttactcttagaaaagtggctggagctaaaggcatagtcaaggttaatgctcctttttctttatcccaaatcagagagcgtttaggctcttcttcatcaaatataaaaacccagcccagttcatggctcgttcggcagcaaccctgagatgctttatagccctagatcctaaaaggtcaaaaggccgtcttattctcaatatacattgtattacccaatctgctcccaacattaaataaagctccaaaaattaaattccggccctcaaaccccacaacaggacttacttaaccttgccttcaaggtgtacaataatagagtagaggcagccaagtagcaacatatttccgagttgcaattccttgcctccactgtgagacaaactccagccacatctccagcacacaagaacttccaaacgcctgaaccgcagtggctaggtgtacatccagaactgcctcccccaggagcttgctacaagtgccagaaatctggccaccaggccaaggaatgcccgcagcccaggattcctcctaagccgtgtcccatctgtgcaggaccccactggaaatcggactgttcaactcacctggcagccactcccagagcccctggaactctggctgaaggctctctgactccttcccagatcttctcggcttagcagctgaagactgacaccgcctgattgcctcagaagcttacaggaccatcacagacgctctaagtaactctcacagtggagagtaagtccgtccccttcttaatacggaggctacccactccacattaccttcttttcaagggcctgtttctcttgcctccataactgttgtaggtattgacagtcaagcttctaaacctcttaaaactcctcaaatctggtgccaacttagacaatactcttttaagcactcctttttagttatccccacctgcccagttcccttattaggccgagacactttaactaaactatctgcttccctgactattcctggactaaggctacatctcattgctgcccttcttcccaatccaaagcctcctttgcgtcctcctcttgtatccccccaccttaacccacaagtataatatacctctactccctccttggtgaccgatcatggaccccttaccatctcattaaaacctaatcacccttaccccgctcaatgccaatatcccatcccacagcatgctttaaaaagattaaagcctgttatcactcgcctgctacagcatggccttttaaagcctataaactctacttacaattcccccatttcacctgtcctcgaaccagacaagccttacaggttagttcaggatctgagccttatcaaccaaattgttttgcctacccatcctgtggtgccaaacccatatactctcctatcctcaatatctccctctactacccattattctgttctggatctcaaacacgctttctttactattcctttgcacccttcatcccagcctctcttcgctttcacttggactgaccctgacactcattaggctcagcaaattacctgggctgtactgccgcaaggcttcacagacaggtcccattacttcagtcaagcccaaatttcatccccatctgttacctatctgggcataattctcataaaaacacacgtgctctccctgctgatcgtatctgactaatctcccaaacctcaatcccttacaaaacaacaactcctttccttcctaggcatgcttag

SEQ ID NO: 365 - DNA, 5203 bp, Homo sapiens
gtcaggcctctgagcccaagctaagccatcatagcccctgtgacctgcatgtacacatccagatggccggttcctgccttaactgatgacattccaccacaaaagaagtgaaaatggcctgttcctgccttaactgatgacgttgtcttatgaaattccttctcctggctcatcctggctcaaaacctcccccactgagtaccttgtgacaccgactctgcctgccagagaacaacctccctttgactgtaattttcctttgcctacccaaatcctataaaacggccccacccctatctccctttgctgactctctttcagactcagcccacctgcacccaggtgaaataaacagccatgttgctcacacaaagcctctttggtggtctcttcacatggacgcacatgaaatttggtgccgtgactcagatcgggggacctgccttgggagatcaatcccatgtcctcctgttctttgctccatgaaaaagatccacatacaacctcaggtcctcagacccaccagcccaaggaacatctcaccaattttaaatcgagtaagcggcctcttcttactctcttctccaacctctctctgtccatcaaccactttctcctttccagtcttcaatctctcccttctcttaatttcaattcctttcattttctagtagagaaaaaggagacacgttttatccatggacccaaaactctggcaccggtcatggactgagaaggcacatttcccttggtgtttaatcattgcagggatgcctgattattcaaccacgtttcaaaggtgtcagaccacccagggacgcctgccttggtccttcacccttagcggcaagtcccgcttttctgggggaggcacaagtaccccaaccccttctctccgtgtctctaccccttctctgcttttctgggggaggggcaagtaccgctcaaccccttctccttcacccttagtggcaagtcccacttttctgggggaggtacaagtaccccaacctcgtacctctgcaccccaatcccttatttccgcaccccgaccccttttctctgtgccccaatcccttatttccacaccctgacctcttatatctctgcaccccaatcccttatttccatgcctggacctcatatctctgcgcccccacccctttcccacttttctggagagtaagaacccccgaaccccttccctccgtgtctctactctctcttttctctgggcttgcttccttcactatgggcaactttccaccctccattcctccttcttctcccttagcctgtatttttaagaacttaaaacctcttcaactctcacctgacctaaaatctaagcatcttatttcttctgcaatgctgcttgaccccaatacaaactcaacagtagttccaaatagccagaaaacggcactttcaatttttccatcctgtaacatctaaataattcttgccgtaaaataggcaaacggtctgaggtgcctgacttccaggcattctttcacacatcagtcccttcctagtctgtgcccaaagcaactcatcccaaatcttcctcctttccctcccacctgtcccctccgtcccaaacccaagcattgctgagtctttctaatcttccttttctacagacccatctgacctctcccctcctccccaggctgctcctcgccaggatgagctaggtcccaattcttcctcagcctctactcctccaccctataatccttttatcacctcccctcctcacaccgggtcccgcttacagtttcattccatgactagccctccccaacctgcccagcaatttactcttaaacaggtgcctggagttaaagacatagtcaaggttaatgctcctttttctttatcccaaatcagatagcatttagcctctttttcatcaaatataaaaatccagcccagttcccggcttgttcggcagcaaccctgagacgctttgcggccctagaccctaaaaagtcaaaaggccgtctaattctcaatatacattttatttcccaatctgcccccgacattaaataaaactccaaaaattaaattctggccctcaaaccccacagcaggatttaattaacctcaccttcaaggtgtacaataatagaaaaaagttgtaattccttacctccactgtgagacaaatcccagccacatctccagcacacaagaacttccaaatgcctgaaccgcagtggccaggcgttcctccgcaacatcctcccccaagagcttgctacaagtgtcagaaatctggccaccaggacaaggaatgcccgcagcccgggattcctcctaagccacgtcccatctgtgcgggaccccactggaaatcggactgttcaactcactggcagctgctcccagagcccttggaactctggcccaagcttctctgactgaccccttctcagcttagcggctgaagactgacgctgcctgagtgcctcggaagccccgtagaccatcatggatgccgagctttaggtaactctcacagtggaggataagtccgtccccttcttaatcaatacggaggctacccactccacactaccttcttttcaagggcctgtttcccttgcctccataactgttgtgggtattgacagccaggcttctaaacctcttaaaactccccaactctggtgccaacttagacaacactcttttaagcactcctttttagttatccccacctgcccagttcccttatttggccgagacactttaactaaattatctgcttccctgactattcctgggtacagccacacctcattgccacattttaccccagttcaaagcctccttcacatcctcctcttgtattaccccatcttaacccacaagtatatgatacctccactccctccttggtgaccaatcatgcacctcttaccatctcgttaaaacctaatcacccttaccccactcaacgccaatatcccatcccgcagcatgctttaaaacatttaaagcctgttatcactctcctgctacagcatggccttttaaagcctataaactctccttacaattcccccattttacctgtcctaaaaccagacaagccttacaagttagttcaggatctgcgccttatcaaccaaattgttttccctatccaccctgtggtgccaaacccatatactctcctatcctcaatacctccctccacaacccattattctgttctgggtctcaaacatgctttctttactattcctttgcacccgtcatcccagcctctctttgctttcacttggactgaccctgacacccatcaggctcagcaaattacctgggctgtactgccacaaggcttcacaaacagaccccattacttcagtcaagcccaaatttcatcctcatctgttacctatcctagcataattctcataaaaacacacgtgttctccctgctgattgtgtctgattaatctccctaacctcaatcccttacaaaacaacaactcctttccttcctaggcatggttagtgcagtcagaattcttacacaagagccaggaccgcaccctgtagcctttctgtccaaacaacttgaccttactgttttaggctggccatcatgtctctgtgcagtggctgctgccgccctaatacttttagaggccctaaaaatcacaaactgtgctcaactcactctctacagttctcataacttccaaaatctattttcttcctcatacctgatgcatatactttctggcgccccggctccttcagctgtactcactctttgttaagtcccacaattaccattgttcctggcccggacttcagtccagcctcccacattattcctgataccatacatgacccccatgactgcatctctctgatccacctgatgttcaccccatttccccacatttccttctttcctgttcctcatcctgatcatgcttgatttattgatggcagttccaccaggcctaatcaccacacaccagcaaatgcaggctatgttaaacacacctcaccaagctcagccgacttaaaaaggactggacaatacttttaccactttcccttctcagaagtcagacctgtcctcagaatgctacaaaatacagcccatttgagctcctgtacagacgctcctttttattaggcctcagtctcattccagacaccagaccaagttagactatgccccaaaaaaacttgtcatccctactgtcttctgtctagtcatactcctattcaccattctcaactactcatacatgccctgctcttgtttacactgccggtttacactgtttctccaagccatcacagctgatatctcctggtgctatccccaagcctccactcttaactcttgaggtaaataaataatctttgctgacaaggctatgctgaacctccttaggcactctctaattagatgtcctaggtcctcccaattcttagacctttaatacctgtttttctccttctcttattccatttagtttttcagttcacacagaactgtatccaggccatcaacaataattctacacgacaaatgtttcttctaacaaccccacgatatcaccccttaccacaaaatcttccttcagcttaatctctcccactctaggttcccacgctgcccctaatcccgctcaaagcagccctgagaaacattgtccattatctctccataccgtcccccaaaattttcgctgtcccaacactttaccactatttcattttatttttctcagtaatataagaagacaggaacgtcaggcctctgagcccaagctaagccatcatagcccctgtgacctgcatgtacacatccagatggccggttcctgccttaactgatgacattccaccacaaaagaagtggaaatggcctgttcctgccttaactgatgacattatcttgtgaaattccttctcctggctcatcctggctcaaaacctcccccactgagtaccttgtggcccccactctgcccgccagagaacaacccccctttgactgtaattttcctttacctacccaaatcctataaaatggccccaccccatctcccttcaatgactctcttttcagactcagcccgcctgcacccaggtgaaataaacagccatgttgctcacacaaaacctgtttggtggtctcttcacatggatgcgcatgaaa

SEQ ID NO: 366 - DNA, 9958 bp, Homo sapiens
gtagggaaaagagagagagatcagactgttactgggtctacatagaaaaggaagacataagaaagtccattttgatctgtaccctgaacaattgttttgcctggagatgctgttaatctgtaactttagccccaaccttgtgctcacagaaatatgtgttgtatggaatcaaggtttaagggatctagggctgtgcaggatgtgccttgttaacaaaacgtttacaggcagtatgcttgataaaagtcatcgccattctccattctcgattaaccaggggcacaatgcactgcagaaagccacagggacccctgcccaggaaagccagtattgtccaaggtttctccccactgagacagcctgaggtatggcctcgtgggacgggaaagacctgaccatcccccagcccaacacccgtgaagggtctgtgctgaggaggattagtaaaagaggaaggcctcttgcagttgaaataagaggaaggcctctgtctcctgcatgcccctgggaacggaatgtctcagtataaaacccgattgtacattcgttctattctgagataggagaaaaccgccctgtggctggaggtgagatatgctggtggcaatactgctctgttattctttactacactgagatgtttgggtggagagaagcatgagtctggcctatgtgcacatccaggcatagtaccttcccttgaacttatttgtgacacagattcctttgctcacatgttttcttgccaaccttctccccgctatcaccctgttctgccacattccccttgctgagatagtgaaaataataatcagtaaatactgagggaactcagagacgggggccggtgcaggtcctctgtatgctgagcgccagtctcctgggccccactgttctttctctatactttgtctctgtgtcttatttctttttttagtctctcgtcccacctgacgagagatacccacaggtgtggaggggcaggccaccccttcatctgccgccaatgtgggtgcctttctctaaggtgaaggtacattaagaacgtgagcattgaggacagtcgacgagagattcccgagtacgtccaccgtcagccttgcggtaagcttgtgtgctcggaggaacccagggtaacaatgggacaaactgaaagtaaatatgcctcttatctcagcttcattaaaattcttttaagaagagggggagttagggcttctacagaaaatctaattacgctatttcaaacaatagaacaattttgcccctggtttccagaacagagaactttagatctaaaagattgggaaaaaaattggcaaagaattaaaacaagcaaatagggaaggtaaaatcatcctacttacagtatggaatgattgggccattattaaagcaactttagaaccgtttcaaacagaagaagatagcatttctgctgcccctgaaagctgtgtaatagattgtgaagaagaggcagagacagagtttaggaaaggaatggaaagttcacattgtaaatatgtagcagagtctgtaatggcttggtcaacgcaaaatgttgactacaatcaattaaaggaggtaatatatcatgaataatcaaaattgggggaaggaggtccagaattattggggccatcagagcctaaaccacgatggccatcaactcctcccgtggttcagatacctgtaacattacaacctcaaagggaggttagacaagtacaaaccccaagagaatatcaagtagaaaaggatagagtctctatcccggcaatgccaattcagatgcagtatccacaatataagctggtagaaaataagacccaaccaccagtaatttatcagtactggccgccagccgaccttcagtatcggccacctccagaggttaaatacagacctcaagtggtgtgtcctgtgccaaatagcacggcaccataccagcaacccacggcagtggtgtttaatcctaccgcaccacctagtggacaaggtagtacactgcatgaaattattgataaagccagtaaacagggagatcttgaggcatgggagttcccggtaattttacaaccgataccggccgggaaagggactctagcaggagcgtctgtccaaactgaagctagatatgaatctttcaccatgaaaatgttaaaagatatgaaggaaggagttaatatggacccaactccccttatgtgagaacattattagattccattgttcatggaaatagacttattccttatgactgggaaattttggctaaatcttccctttcaccctctcagtttctacagtttaaaccgtggtggatcgatggagtacaagaacaggtacgaaaaaatcaggttactaaccccactgttaatatagatgcagaccaattgctaggaacaggtccaaattggagcaccattaaccaacaatcagtaatgcagaacacctgttgaacacctaagggctattgaacacctaagggctatttgcctcagggcctgggaaaaaattcaggacctgggaaccacctgcccttcttttaattcaattagacaagtctctaaagagccatatccagactttgtggcaaggttgcaagatgctgctcaaaaatctgttacagatgataacgcccgaaaagatattgtagaattaatggcctatcaaaatgcaaatccagaatgtcaatcggccataaagccattaaaaagaaaagttccagcaggagttgatgtaattacagaataagtgaaggcttatgatgggattggaggagctatgtataaaggcaatgctaatggctgaagcaatagcgggagtcgctttaggaggacaagttagaacatttgggaaaaaatgttataattgtggtcaaatcggtcatccgaaaaggagttgcccagtcttaagtaaacagaatataataaatcaagctggccgggcacggtggctcacacccgtaatcccagcactttgggaggccgaggctggtagatcacaaggtcaggaggtcgagactatcctggctaacatggtgaaaccccatctctactaaaaatacaaaaaattagccaggcgtggtggcgggtgcctatagtcccagctactcgggaggctgaggcaggagaatggcatgaacccaggaggcagagcttgcagtgagccgagatcgcaccactgcactccagcctgggcaacagagccagactccgtctcaaaaaaaagaaaaatataaatataaataaatcaagctataacggcaaaaaataaagagccacctggcctgtgtccaaaatgtggaaaaggaaaacattgggctaatcaatgtcattctaaatttgataaagatgggcaaccattgttggggaaatgggaagaggggccagcctcaggccccgcaacaaattggggcattccgattcagccgtttgttcctcagggttttcagggacaaaaactcccgcaggaaataccaccacttcagggagtcagccaattacaacaatacaacagctgtcccctgccacagcaggcagcgcagcagtagatttgtgttctactcaaatggtttctttactccctggagagcccccgcaaaagattcctacaggggtatatggcccgctgccagaagggacggtaggccttattttagggagatcaagtctaaatttgaagggagtccaaattcatactggtgtaattgattcagattataaaggggaaattcagttagtgatcagctccactgttccctggagtgccaatccaggtgatagaattgcacaattactgcttttgccttgtattaaaattgggaaaaacaaaacggaaagaacaggagggtttggaagtaccaaccctgccggaaaagccgcttattgggctagtcaggtctcagaggatagacccgtgtgtgcagtcactattcagggaaagcagtttgaaggattagtggatactgggtgatggtgctatcattgccttaaatcaatggccccaaaattggcctaaacaaaagcctgttacaggacttgtcggcgtaggcactgcctcagaagtgtatcaaagtgccatgagtttacattgtctaggacctgatgatcaagaaagtacagttcagcctatgatcacttctattccaattaatttatggggccgagacttgttacaacaatggcatgcagcgattactatcccagcccccaatacagccccacgagtcaaaaaatcataactaaaatgggatatctccctgaaaagggactaggaaagaatgaagacagcattaaagtcccaattgaggctgaaaaaactcaaaaaagaaaaggaatagggtatcctttttaagagcggccactgtagagcctccaaaacccattccattaacttggaaaacaaaaaaacctgtatgggtgaatcagtggctgctaccaaaacaaaagctggaggctttacacttattagcaaaggaacaattagaaaagggacatattgagccttcattttcgccttggaattctcctgtgtttgtaattcagaaaaaatccggcagatggcgcgtgctgaccgacttaagagccgttaatgctgtaattcaacccatgggggctctccaacctgggttgctctctccggtcatgatccccaaagatcggcctttagttataattgatctgaaggattgcttttttaccgttcctctggcaaaacaggattttgaaaaatttgcttttactataccagccataaataataaagaaccagccaccaggtttcagtggaaagtgttgcctcagggaatgcttaatggtccaactatttgccagacttttgtagctcaagctcttcaaccaattagagacagttttcagactcttatatcattcattatgttgatgatattttgtgtgctacagaaaggagagacaaattaattgactgttacacatttctgcagacagaggttgcaaacgcaggactgacgacagcatctgataagattcaaacctctactcctttccattacttggaaatgcaggtggaggaaacgaaaattaaaccataaaaaatagaaataagaaaagacacattaaaaacattaaatgactttcaaaaattgctaggagatattaattggattcagccaactctaggcatctctacttatgccatgtcaaatttgttctctatcttaagaggggatccagaattgaatagtaaaagaacattaactccagaagcaactaaagaaattgaattagttgaagaaaaaattcggtcagcacaagtaaatagaatagatcacttagccccactccaacttttgatttttgctactgcacattctccaacaggcattattgctcaaaatacagatcttgtggagtggttcttccttcctcatagtacaattaagacttttacattgtacttggatcaaatggctacattaattggtcaggcaagattacgaataataaaattgtgtgaaagtgactcagataaaatcattgttcctttaaacaaggaacaggttagacaagcctttatcaattctggtgcatggcagattggtcttgctgattttgtgggaattattgacaatcattacccaaaaacaaaaatcttccagtttttaaaattgactacttggattttacctaaaattactagacataaacctttagaaaatgctctgacagtgtttactgatggttccagcaatggaaaagcggcttacaccaggccaaaagaacgactcattgaaactcaatatcactgggctcaaagagcagagttggttgctgtcattacagtgttacaagattttaatcagcctattaacattgtatcagattctgcatatgtagtacaggctacaaaggatgttgagacagccctaatcaaatatagtatagatgatcagttaaaccagctgtttaatatgttacaacaaactgtaagaaaaagaaatttcccattttatgttactcatattcgagcacatactaatttaccagagcctttaactaaagcaaatgaacaagttgacttgctagtatcatctgcattcctggaagcacaagaacttcatgccttgactcatgtaaatgcaacaggactaaaaaataaatttgacatcacatggaaacaggcaaaaaatattgtacaacattacacccagtgtcagattccacacctgcccactcaggaggcaggagttaatcccagaggtctgtgtcctaatgcgttatggcaaatggatgtcacacatgtaccttcagttggaaaattgtcatttctccatgtgacagttgatgcttattcacattttgtaagggcaaactgccagacaggagaaaatacttcccatgttaaaagacatttattatcttgttttgctgtcatgggagttccagaaaaaattaaaacggataatgggccaggatactgtagtaaaacatttcaaaaattcttaaatcagtggaaaattacacatacaacaggaatcccttataattcccaaggacaggccataattgaaaaaactgatagaacactcaaagctcaattggttaaacaaaaaaaggaaaaaagacagtaaggagtataacactccccagatgcaacttaatctagcactctatactttaaattttttaaacatttatagaaatcaaaccactacttctgcagaacaacattttactggtaaaaagaatagcccacatgaaggaaaactgatttggtggaaagacaagaaaaataagacatgggaaatagggaaggtgataacatgggagagaggctttgcttgtgtttcacaaggagaaaatcagcttcctggttggatacccactagaaatttaaagttctacaatgaaccccttggagatgcgaagaaaagcgcctctgcggagacaaaaaaccctcaattgagcatcatcgactcgccaggtaaataaaatggtgatatcagaagaacagatgaagttgccatccaccaaggaagcggagccaccgacttgggcccaattaaagaagctgacacagttagctaaaaaaagcctaaagaacacaagggtaatgtgaactccagagaatatactgcttacagctttgattattatatcaacggtagtaagtctccccatgtctgcaggagcagctgcaactaattatacttactgtgcctatgtgcctttcccacccttaatttgggcagtcacatggatggataatcctgttgaagtatatgttaataatagggcatgggtaccaggccccacagacgattgttgccctgcccaacctaaagaagaaggaatgatgataaatgtttccactgggtatcattatcctcctatttgcctagggaaggcaccaggatgtttaatgcctacaacccaaaactggttggtagaagtacctaccgtcagtgccaccagtaaatttacttatcacatggtaagtggaatgtcactcgggccacagataaataatttagaggacgcttcttatcaaagatcattaaaatctgggcctaaggggaagccttgccccaaggaaattcccaaagaatcaaaaagcccagaagccttagtttgggaagaatgtgtggctaatactgcggtggtattacaaaacaatgaatttggaactactataatattatataatagttatatattatattatattatatacaattatattatatataattgtatgggccagactcactcatgtttacaggccccatccatctggcccattaatccggcctatgatagtgatttaattgaaaggctggaccaggtttatagaaggctagaatcaccctatccctggaaatggggtgaaaagggaatttcatcacctcgaccaaagttagttagtcctgttactggtcctaaacatccaaaattatggaagcttactgtggcctcgcactacattagaatttggtctggaaatcaagctacagaaacaagaaatcgtaagccatattatactatcaacctaaattccaatctgacaattcctttacaaagttgtgtaaaacccccttatatgctagttatagaaaacatagttattaaaccagattcccaaactataacctgtgaaaactgtagattgtttacttgcattgatttgacttttaattggcagcgccatattctgctagtgagggcaagagaaggtgtgcggatccctgtgtccatggaccgacagtgggaggcttcgccatcttccatattttaacggaagtattaaaaggaattctaactagatccaaaagatttttactttgattgcagtgattatgggccttattgcagtcacagctactgctgcagctgctggaattgctttacactcctctgttcaaactgcagaatatgtaaatgattggcgaaagaattcctcaaaattgtggaattctcagacccaaataaatcaaaaattggcaaacgaaattaatgatcttagacaaactgtcatttggctgggaaataggctcatgagcttggaatatctttttcagttacagtgtgactggaatatgtcagatttttgtattacaccccaagcctataatgagtctgagcatcactgggacatggttagatgccatctacagggaagagaagataatcttactttagatatttcaaaattaaaataacaaaattttgaggcatcgaaagcccatttaaatttgggaactgaggcaatcgtgaaagctactgatggcctcacaaatcttaacactgtcacttggttaaaaaccatcagaagttccactattgtaaatttcatattaatccttgtatgcctgttctgtctgttgttagtccacaggtgtatccaccagctccgaagagacagcgaccagcaagaacgggccataacgacgatggcagttttgtcaaaaagggggatatgtagggaaaagagagatccgactgttactgtgtctacatagaaaaggaagacataagaaactccattttgatctgtaccctgaacaattgttttgccttgagatgctgttaatatgtaactttagccccaaccttgtgctcacggaaatatgtgttgtatggaatcaaggtttaagggatctagggctgtgcaggatgtgccttgttaacaaaatgtttacaggcagtatgcttggtaaaagtcatcgccattctccattctcgattaaccaggggcacaatgcactgcagaaagccacagggacctctgcccaggaaagccaggtattgtccaaggtttctccccactgagacagcctgaggtatggcctcgtgggacgggaaagacctgaccatcccccagcccgacacccgtgaagggtctgtgctgaggaggattagtaaaagaggaaggcctcttgcggttgagataagaggaaggcctctgtctcctgcatgcccctgagaacggaatgtctcagtataatacccgattgtacattcgttctattctgagataggagaaaaccgccctgtggctggaggcgagatatgctggtggcaatactgctgtgttattctttactacactgagatgtttgggtggagagaagcatatatctggcctatgtgcacatccaggcatagtaccttcccttgaacttatttgtgacacagattcctttgctcacatgttttcttgctgaccttctccccgctatcaccctgttctcctgctgcattccccttgctgagacagtgaaaataataatcagtaaatgctgagggaactcagagactggggccagtgcaggtcctccgtacgctgagcgctggtctcctgggcccagtgttctttctctatactttgtctctgtgtcttatttctttttttagtccctcgtcccacctgacgagaaatacccgcaggtgtggaggggcaggccaccccttca

SEQ ID NO: 367 - DNA, 5866 bp, Homo sapiens
gtcaggcctctgagcccaagctaagccatcatatcccctgtgacctgcacgtacacatccagatggctggttcctgccttaactgatgacattccaccacaaaagaagtgaaaatggcctgttcctgccttaactgatgacattatcttgtgaaattccttctcctggctcatcctggctcaaaagctcccctactgagcaccttgtgacccccactcctgcccaccagaaaatccccctttttcctttacctacccaaatcctataaaacagccccacccctatctcccttcactgactctctttttggactcagcctgcctgcacccaggtgaaataaacagctttattgctcacacaaagcctgtttgatggtctcttcacacggaagcaagtgaaatttggtgccgtgactccgatcaggggacctcccttgggagatcaatcccctgtcctcctgctctttgctccgtgagaaagatccacctacgacctcaggtcctcagaccgaccagcccaagaaacatctcaccaatttcaaatccggtaagcggcctctttttactctcctctccaaactccctcactatccctcgacctccttctcctgtcaatcttggcgccacacttcaatctctcccttctcttaatttcaattcctttcattttctggcagagacaaaggagacacgttttatccgtggacccaaaactccagcgccggtcatggactagggaagtcagccttcccttggtgtttaatcattgcaaggacacctgattattcccccaggtttcagaggtgtcagatcacgcagggacgcctgctttggtccttcacccttagcggcaagtcccacctttctgggggaggggcaggaaccccaatctcttatctctacaccccaatcccttatttccacgccccgacctcttatctttgtgccctgatcccttatttccacaccgcgacctcttatctctgtgccccaaccccttatttctgagccccgaccccttctctgcttttctggagggcaagaagcccccaccccttctccgtgtctctactcatttttctctgggcttgcctcattcactatgggcaagcttccaccttccattcctccttcttctcccttagcctgtgttcttaagaacttcaaacctcttcaactctcacctgacctaaaatctaagcgtcttattttctctgcaatgccacttgaccccaatacaaactcgacagtagttccaaatagccggaaaatggcactttcaatttttccatcctacaagatctaaataattcttgttgtaaaataggcaaacggtctgagatgcctgatgtccaggcattcttttacacattggtccctccctagtctgtgttcccaatgtgactcgtcccaaatgttccttctttccctcccacctgtcccctcagtcccaaccccaagcgtcactgagtctttctactcttccttttctacagacccatctgacctctcccctcctcgccaggccgagctaggtcccaattcttcctcagcctccgctcctccaccctataatccttttatcacctccctcctcacacctggtctggcttacagtttcattccgtgactagccctcccccacctgcccagcaatttacttttaataaggtggctggagctaaaggcatagtcaaggttaatgctcctttttctttatcccaaatcagatagcgtttaggctctttttcatcaaatataaaaatccagcccagttcatgacttgttcggcagcaaccctgagacgctttacagccctagaccctaggtctaggccgtcaatcattgcaggtcaaaaggccgtcttattctcaatatacattttattacccaatctgctcccgacattaaataaaactccaaaaattaaattccggccctcaaaccccacaacaggacttaattaatctccccttcaaggtgtacaataagagaatagagacagccaagtagcaaagtatttctgagttgcaattccttgcctccactgtgagacaaaccccagccacatctccagcacacaagaacttccaaatgcctaaaccgcagtggccaggcgttcctccagaactgcctcccccagaagcttgctacaagtgccagaaatctggccaccaggccaaggaatgcccgcagcccgggattcctcctaagccatgtcccatctttgtgggaccccactggaaatcggagtgttcaactcacctggcagccactcccagagcccctggaactctggcccaaggctctctgaccgactccttcccagatcttctcggcttagcggctgaagactgacgctgctcgtagaccatcacggacgccgagctttaggtaactctcacagtggagggtaagtccgtccccttcttaatcaatgcggaggctacccacgccacattaccttcttttcaagggcctgtttcccttgcctccataactgttgtgggtattgacggccaggcttctaaacctcttaaaactccccaactctggtgccaacttagacaatactcttttaagcattcccttttagttatccccacctgcccagttcccttattaggccgagacactttaactaaattatctgcttccctgactattcctggactacagctgcatctcattgccacccttcttcccaatccaaagcctcctttgcatcctcctcttgtatcccctcaccttaacccacaagtataagatacctctactccctccttggtgactgatcttgcacccctaaccatctcattaaaacctaatcacccttaccccgttcagtgccaatatcccatcccacagcatgctttgaaaggattaaagcctgttatcactcgcctgctacagcatggcctcttaaagactataaactctccttacaatgcccccattttacctgtcctaaaaccagacaagccttacaagttagttcaggatctatgccttatcagccaaattgttttgcctatccaccccatggtgccaaacccatatactctcctatcctcaatacctccctccacaacccattatcctgttctggatctcaaacatgctttctttactattcctttgcacccttcatcccagcctctcttcactttcacttggactgaccctgacacccatcaggcttagcaaattacctgggccatactgccgcaaagcttcacagacagcccccattacttcagtcaagcccaaatttcttccttatccgttacctatttcagcataattctcataaaaacacaagagccctccctgccgatcgtgcccgactaatctctcaaaccccaaccccttctacaaaacaacaactcctttccttcctgggcatggttggatactttcgcctttggatacctggttttgccatcctaacaaaaccattatataaactcacaaaaggaaacctagctgaccccatagatcctaaatcctgtccccactcctctttccattccttgaagacagctttagagactgcccccaccctagctctccctgactcacccaccccttttcattacacacagctgaagtgcagggctgtgcagtcagaattcttacacaaggaccgggatcgcgtcctgtagcctttttgtccaaacaacttgaccttactgttttaggctggccatcatgtctctgtgcagcggctgctgccgccctaatacttttagaggcccttaaaatcacaaactatgctcaactcactctctacagctctcataatttccaaaatctgttttcttcctcacacctgacacatatactttctgctccccggctccttcagctgtactcactctttgttgagtctcccacaattaccattgttcctggcccggacttcaatccggcctcccacattattcctgataccacacctgaccctcatgactgcatctctctgatccacctgacattcaccctatttccccacatttccttcttccctgcttctcaccctgatcacacttggtttatagacggcagttccaccaggcgtaatcgccacacaccagcaaaggcaggctgtgctatagtacaagccactagcccgcctcttagaacctctcatttcctttccatcgtggaaatatatcctcaaggaaataacttctcagtgttccaactgctattctactgctcctcagggattattcaggctccctcccttccctacacatcaagctcagggatttgcccccacccaggactggcaaatttgctattctactacttctcagggattattcaggccccctcccttccctacacatcaagctcagggatttgcccctgcccaggactggcaaattagctttactcaacatgccccgagtcaggaaactaaaatacctcttggtctaggtagacactttcactaggtaggtagaggcctttcccacagggtctaagaaggccatcatggtcatttcttcccttctgtcagacataattcctttgtttggccttcccacatctatacagtccaatagcagaccggcctttattagtcaaatcagccaagcattttttcaggctcttatattcagtgaaacctttatatcccttacagtcctcagtcttcaggaaaggtagaacagactaatggccttgtaaaaacacacctcaccaagctcagccaccaacttaaaaaggactggacaatacttctaccactttcccttctcagaattcaggcctgtcctcagaatgctacaaggtacagcccatttgagctcctgtatagacgctccttttcattaggccccagtctcattccagacaccagactaacttggactgtgcccccaaaaacttgtcatccctactatcttctgtctagtcatgctcctattcaccgttctcaactactcacacatgccctgctcttgtttacactgccagtttacactgtttctccaagccatcacagctgatatctcctggtgctatccccaaaccgccacgcttaactcttaaagtaaataaataatctttgctggcaaggctatgctgaacctccttaggcactctctaattagatgtcctaggtcctcccaattcttagacctttaatacctgtttttctccttattctgtttaatttttcaattcacacaaaactgtatccagaccatcaccaacaattctaaatgacaaatgtttcttctaacaaccccacaatatcaccccttaccacaaaatcttccttcagcttaatctctcccactctaggttccgacgctgccccaatcccgctcgaagcagccctgagaaacatcgcccattatctctccataccataccccaaaaaattttcaccatccgaacactttaccactatttcattttatttttcttattaatgtaagaagacaggaatgtcaggcctctgagcccaagctaagccatcatatcccctgtgacctgcacgtacacatccagatggctggttcctgccttaactgatgatattccaccacaaaagaagtgaaaatggcctgttcctgccttaactgatgacattatcttgtgaaattccttctcctggctcatcctggctcaaaagctcccctactgagcaccttgtgactgctactcctgcccgccagaaaccaacccccctttttcctttacctacccaaatcctataaaacagccccacccctatctcccttcactgactctctttttggactcagcccgcctgcacccaggtgaaataaacagctttattgctcacacaaagcctgtttggtggtctcttcacacggacgtgagtgaaa

SEQ ID NO: 368 - DNA, 174 bp, Homo sapiens
cccagaggtttctttatttgggaaaataagaccaagggagctaaacaaaaccaagccccatgcacccaaatcttagcaggcataactatagccaccagttatctgggcatgtcagcagccttgggattttttatctatctttacccccttgtttcattttgatatatgtcttct

SEQ ID NO: 369 - DNA, 90 bp, Homo sapiens
tcaccaccatcttggaagcagcacaccgccatcttggaagtggcctgccaccatcttgggagctctgggagcaaggatcccccggtaaca

SEQ ID NO: 370 - DNA, 5888 bp, Homo sapiens
gtcaggcctctgagcccaagccaagtcatcgcatcccctgtgacttgcacgtatacacccagatggcctgaagtaactgaagaatcaccaaagaagtgaatatgccctgccccaccttaactgatgacattccaccacaaaagaagtgaaaatggccagtccttgccttaagtgatgacattcccttgtgaaagtccttttcctggctcatcctggctcaaaaagctcccccactgagcaccttgcgacccccactccagcccgccagagaacaaaccccctttgactgtaattttcctttacctacccaaatcctataaaacggccccacccttatctcccttcgctgactatcttttcggactcagcctgcctgcaaccaggtgaaataaacagccatgttgctcacacaaagcctgtttggtggtctcttcacatggacgtgcatgaaatttggtgctgtgactcggatcgggggacctcccttgggagatcaatcccctgtcctcctgttctttgctccgtgagaaagatccacctacgacctcaggtcctccgaccgaccagcccaagaaacatctcaccaatttcaaatccggtaagtggcctcttcttactctcttctccaacctctctcactgtccctcaaccactttcttctttccattcttcaatctctcccttctcttaatttcaattcctttcattttcagggagagacaaaggagacacgttttatccgtggacccaaaactccggcgccggtcacggactgggaaggcagccttcccttggtgtttaatcattgcagggacgcctctctgattatacacccacgtttcaagggtgtcagaccacgcagggatgcctgccttggtccttcacccttagcggcaagtcccacttttctggggaaggggcaagtacctcaaccccttttctccttgtctctaccccttctctgcttttctgggagaggggcaagtacccctcaaccccttctctccttgtctctaccccttctctgctttcctggggcaggggcaagtacccctcaaccccttctccttcacccttagcggcaagtcctgctttcctggggcaggggcaagtacccctcaaacccttctctttcacccttagtggcaagtcccgcttttctagggggcaagaacccccaatcccttatttccgcaccccaacctcgtatctctgtgccccaataccttatttctgtgccccgacctcttatttccatgccccaaccccttatttctgtgccccatcccttatttccatgccctgacctcttatctctgcgccccaaccccttttcccacttttctggaaggtaagaacccccgaaccccttccctccgtttctctactctctcttttctctaggcttgcttccttcactataggcaactttccaccctccattcctctttctactcccttggcctgtgttctcaaaaacttaaaacctcttcaactcacacctgacctaaaacctaaatgccttattttcttctgcaatgccacttgaccccaatacaaactcaacagtagttccaaatagccagaaaacggcactttgaatttttccatcctacaagatctaaataattcttgtcgtaaaataggcaaacggtctgaggtgcctgacgtccaggcatcctttacacatcagtcccttcctagtctctgtgcccagtgcaacccgtcccaaatcttccttctttccctcctgcctgtcccctcagtaccaacaccaagcgtcgctgagtctttctaatcttccttttctacagacccatctgacctctcccctcctcgccaggccgagctaggtcccaattcttcctcagcctccgctcctccaccctataatctttttatcacctcccctcctcacacctggtccggcttacagtttcgttccgtgactagccctcccccacctgcccagcaatttactcttaaaaaggtggctggagccaaaggcatagtcaaggttaatgctcctttttctttatcccaaatcagatagcgtttaggctctttttcatcaaatataaaaatgcagcccagttcatgatttgtttggcagcaaccctgagacgctttacagccctagaccctaaaaagccaaaaggccgtcttattctcaaaatacattgtattacccattctgctccgaaataaaactccaaaaattaaattccagccctcaaaccccacaacagtatttaattaacctcgcctttaaggtgtacaataatagaaaaaagttgcaattccttgcctccactgtgagacaaaccccagccacatctccagcacaagagaacttccaaacgcctgaaccgcagcagccaggcgttcctccagaacctcctcccccaggagcttgctacacatgccggaaatctggccactgggccaaggaatgcccgcagcctgggattcctcctaagccgcgtcccatctgtgtgggaccccactgaaaatcggactgttcaactcacctggcagccactcccagagcccctggaactctggcccaaggctctctgactccttcccagatcttctcggcttagcggctgaagactgacactgcccgattgcctcggaagccccctagaccatcaaggacgctgagcttcaggtaactctcacagtggaaggtaggcccgtccccttcttaatcaatacggaggctacccactccacattaccttcttttcaagggcttgtttcccttgcctccataactgttgtgggtattgacggccaggcttctaaacctcttaaaactccccaactctggtgccaacttagacaatactcttttaagcactccttttcagttatccccacctgcccagttcccttattaggctgagacactttaactaaattatctgcttccctgactatccctggactacagctatatctcattgccacccttcttcccaatccaaagcctcctttgcgtcctcctcttgtatccccccaccttaacccacaaatatgagatacctctactccctccttggcgaccgatcatgcaccccttaccatctcattaaaacctaatcaccattaccccactcagcgccaatatccaatcccgcagcacgcttgaaaaagattaaagcctgttatcactcgcctgctacagcatggccttttaaaacctataaactctccttacaatttccccattttacctgtcctaaaaccagaagagccttacaacttagttcagaatctgtgctttatcaaccaaattgttttgcctatccaccccgtggtgccaaacccatatactctcctatcctcaatacctgcctctacaacccattattctgttctagatctcaaacatgctttctttactattcctttgcacccttaatcccagcctctcttcgctttcacttggactgaccctgacacccatcaagctcagcaaattacctaggctgtactgccgcaaagcttcacagacagcccccattacttcaatcaagcccaaatttcctcctcatctgttacctatcttggcataattctcataaaaacacacgtgctctccctgccaatcgtgtctgactgatcactcaaaccccagcaccttctacaaaacaacaactcctttccttcctaggcatggttagcgcggtcagaattcttacacaagagccaggaccgcaccctgtagcttttctgtccaaataacttgacattactgttttagcctagccctcatgtctgcgtgcagcggctgccgctgcattaatacttttagaggccctcaaaatcgcaaactgtgctcaactcactctctatagttctcataacttccaaaatctattttcttcctcatacctgacgcatatactttctgcttcctggctccttcagctatactcactctttgttgagtctcccacaattaccgttgttcctggcccggacttcaatctggcctcccacattattcctgataccacacctgacccccatgactgtatctctctgatccacctgacattcaccccatttccccaaatttccttctttcctgttcctcaccctgctcacacttgatttattgatggcagttccaccaggcctaatcgccacacaccagcaaaggcaggttatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagctcgaggatttgcccccgcccaggactggcaaattagctttactcaacatgccctgagtcagataactaaaatacctcttagtctaggtagatactttcactggataggtagaggcctttcctacagggtctgagaaggccaccgcagtcatttcttcccttctgtcggacataattcctcagtttaggcttcccacctctatacagtctgataacagacgagcctttattagtcaaatcagccaagcagtttttcaggctcttagtattcagtgaaacctttatatcccttacggtcctccgtcttcaagaaaagtagaatggactaaaggtcttttaaaaacacacctcaccaagccagccaccaacttaaaaaggaccggacaatacttttaccactttcccttctcagaattcaggcctgtcctcggaatgctacagggtacagcccatttgagctcctgtatagatgctctttttattaggccccagtctcattccagacaccagaccaacttagactgtgcccccaaaaaaacttggcatccctactatcttctgtctagtcatacatactcctattcaccgttctcaactactcatacatgccctgctcttgattacactgccagtttacactgtttttccaagccatcacagctgatatctcctgatgctatccccaaactgccacacttaactcttgaagtaaataaataatctttgctggcaggactatgctgaatctccttaggcactctctaatcagatatcctgagtcatcccaattcttagacgttttatacctgtttttctccttccgttattccatttagtttctcaattcatccaaaaccgtatccaggccatcaccaaatgtttcttctaacaaccccacaatatcaccccttaccacaagacctcccttcagcttaatctctcccactctaggttcccacaccgcccctaatcccgcttgaagcagccctgagaaacatcgcccattctctctccataccaccccccaaaaatttttgccgcgccaacacttcaacatcgttttgttttatttttcttattaatataagaaggcaggaatgtcaggcctctgagcccaagccaagccatcgcatcccctgtgacttgcacgtatacacccagatggcctgaagtaactgaagaatcacaaaagaagtgaatatgccctgccccaccttaactgatgacattccaccacaaaagaagtgaaaatggccagtccttgccttaagtgatgacattcccttgtgaaagtccttttcctggctcatcctggctcaaaaagcacccccactgagcaccttgtgacccccactcctgcccgccagagaacaaaccccctttgactgtaactttcctttacctacccaaatcctataaaacggccccacccttatctcccttcgctgactctcttttcggactcagcctgcctgcacccaggtgaaataaacagccatgttgctcacacaaagcctgtttggtggtctcttcacagggacgtgcatgaaa

SEQ ID NO: 371 - DNA, 449 bp, Homo sapiens
gtcaggcctctgagcccaagctaagccatcacatcccctgtgacctgcacatatacatgcagacggcctgaagcaactgaagaaccacaaaagatgatattccaccattgtgatctgttccttctccaccctaactgatcaattgagtttatgacaatatgcccttcccgcccttgcgataatgtacttgtgatattcccccacccttaagaaggtactttgtaatattctccccacccttgagaatgtacttggggagatccatccactgcccacaaaacattgctcctaactccaccgcccatcccaaacctataagatctaatgataatcccaccaccttttgctgactctcttttcagactcagccagcctgcacccaggtgattaaaaagctttattactcacacaaagtctgtttgatggtctcttcacgcagatgcacctga

SEQ ID NO: 372 - DNA, 9811 bp, Homo sapiens
gtcaggcctctgagcccaagctaagccatcatatcccctgtgacctgcatgtacacatccagatggccagttcctgccttaactgatgacattccaccacaaaagaaatgaaaatggcctgttcctgccttaactgatggcattatcttgtgaaattccttctcctggctcatcctggctcaaaagctcccctactgagcaccttgtgacccccattcctgcccgccagagaacaacccccctttttcctttacctacccaaatcctataaaacggtcccaccctatctccctttgctgactctcttttcggactcaacctgcctgcacccaggtgattaaaagctttattgctcacacaaagcctgcttggtggtctcttcaaatggacgtgagtaaaatttggtgccatgactcagatcgggggacctcccttgggagatcaatcccctgtcctcctgctctttgctccatgagaaagatccacctacgacctcaggtcctcagaccgaccagcccaagaaacatctcaccaatttcaaatctggtaagtcacctctttttactctcttctccaatctccttcactatccctcaacctctttctcctttcaatcttggcaccacacttcaatctctcccttctcttaatttcaattcctttcattttctggtagagacaaaggagacacgttttatccatggacccaaaactccggcgccagtcacaaactgggaaggcagccttcccttggtgtttaatcattgcagggatgcctctctgattattcaccctcgtttcagaggtgtcagaccacgcagggacgccgcctgccttggtccttcacccttagtggcaagtctgcttttctgggggaaaggcaagtaccccaaccccttctctccgtgtatctaccccttctctgcttttctgggggagggacaagaaacccccaaccccttctccttcaccctaagtggcaagtcccacttctctagaggatggacaagtaccccaacctcatatctctgctccccaatccctcatttctgcacccctacctcatatctctgcgccctgatcccttatttctgcaccctgacctcatatctctgcaccccaacccctttcctgcttttctggagggtaagaacccccaaaccccttccctccatatctctactctctcttttctctaggcttgcttccttcactatagggaaacttccaccctccgttcctccttcttctcccttagcctgtgtctcaaaaacttaaaacctcttcaactcacacctgacctaaaacctaaatgccttattttcttctgcaacactgcttggccccagtgcaaacttggcaatggctctgaatggccagaaaacagcacttttgatttctccatcctacaagacctaaataatttttgtcgaaaaataggcaaatggtctgaagtgccttatgtccaggcatttttcacaattcgttccctccctagtctctgttcccaatgtgattcctcccgaatcctccttctttccctcccacctgtcccctcagtcccaaccccaagcatccataagtctttctactcttccttttctacagacccatctgacctctcccctcctccccaggctgcgcctcaccaggccgagctaggtcccaattcttcctcagcctctgctcctccaccctgtaatctttttatcacctctcctcctcacacccaatccagtttacagtttcattccgtgagcagccctcccccacctgcccagcaatttcctcttaaaaaggtggctgaagctaaaggcatagtcaaggttaatgctcctttttctttatcagacctctcccaaatcagtgagtgtttaggctctttcatcaaatatgaaaaacccagcccagttcatggctcgttcgtcagcaaccctgagatgctttacagctctagaccctaaaaggtcaaaaggccgtcttattctcaatatacattttattacccaatctgctcccaacattaaataaaactccaaaaattgaattccatccctcaaaccccacaacaggacttaattaacctcaccttcaggtgtacaataataaaatagaggcagccaagtaacaacatatttctgagttgcaattcctttcctccactgtaagacaaaccccaaccagatctccagcacacaagaactccaaacacctgaaccgcagctgccaggagttcctccagaacctcctcccccaggagcttgctacaagtgccagaaatctggccactgggccaaggaatgcccatagcccaggattcctcctaagccatctcccatgtgtgcaggaccccactgaaaataagactgttcaactcacctggcagccgcttccaaagcccctcgaactctggcccaaggctctctgactgactccttcccagatcttcttggcttagcagctgaagactgacactgcccgattgcctcagaagcctacaggaccatcacagatgctctaagtaactctcacagtagaaagtaagtccatccccttcttaatcaatacagaggctactcactccacattaccttcttttcaagggcctgtttcccttgcttccataactgttgtgcatattgatggccaggcttctaaacctcttaaaactccccaactctggtgccaacttagacaatactcttttaagcattcctttttagttatccccacctgcccagttcccttattaggaccagacactgtaactaaattatctgcttccctgactattcctaggctacagccacacctcattgccaccttttcccccagttcaaagcctccttcacatcctccccttgtatctccccaccttaacccacaagtataagacacctctactccctccttagtgaccgatcatgcaccccttaccatcccattaaaacctaatcacgcttacctcgctcaatgccaatatcccatcccatagcacgctttaaaaagattaaagcctgttatcactcgcctgttacagcatggccttttaaagcctataaatgctccttaccattcccccattttacctgtcctgaaaccagacaaggcttacaggttagttcaggatctgagccttatcaaccaaattgttttgcctctccaccccatggtgccaaacccatatactctcctatcctcagtacctccctttataacccattattctgttctagatctaaaacatgctttctttactattcctttgcacccttcatcccagcctctcttcactttcacttagactgaccctgacacccattaggctcagcaaattacctaggctgtactgccgcaaggcttcacagacagcccccattacttcaatcaagcccaaatttcatcctcatctgttacctatctcggcataattctcataaaaacacacgtgctctccctgctgatcatgtccaattaatctcccaaacctcaatcccttacaaaacaacaactcctttccttcctaggcatggttagtgtggtcagaattcttacacaagagccaggaccgcaccctgtagcctttctgtccaaacaacttgacctcactcttttagcctagccctcatgtctgcgtgcagcggctgccactgctttaatacttttagaggcccttaaaatcacaaactgctcaactcattctctgcatttctcataactttcgaaatctattttctttctcatacctgacgcgtatactttctgctccccggctccttcagctgtactcattctttgttaagtcccacaattaccattgttcctggcccggacttcaatccggcctcccacattattcctgataccacacctgacccccatgactgtatctctctgatccatctgacattcaccccatttccccatatttccttcttccctattcctcgccctgatcatgcttgatttattgatggcagttccaccaggcctaatcgccacacaccagcaaaggcaggctatgctatagtacaagccactagcccgcctcttagaacctctcatttcctttccatcgtggaaatctatcctcaaggaaataacttctcagtgttccatctgctgttctactactcctcagggattattcaggacccctcccttccctacacatcaagctcgaggatttgcccccacccacgactggcaaattagctttactcaacaagccccgagtcagataactaaaatacctcttagtctaggtagacagtttcactggataggtagaggcctttcctacagggtctgagaaggccaccacagtcatttcttcccttctatcagacataattcctcagtttagcgttcccacctctatacagtctgataacagaccagcctttattactcaaatcagccaagcagtttttcaggctcttagtattcagtgaaacctttatatcccttacagtcctccgtcttcaagaaaagtagaacggactaaaggtcttttaaaaacacacctcaccaagctcagccaccaacttaaaaaggacgggacaatacttttaccacttttccttctcagaagtcagacctgtcctcagaatgctacaaggtacagcccatttgagctcctgtatagatgctcctttttattaggccccagtctcattccagacaccagaccaacttagactgtgcccccaaaaaaacttgtcatccctactatcttctgtctagtcatactcctattcaccattctcaactactcatacatgccctgctcttgtttacactgccggtttacactgtttttccaagccatcacagctgatatctcctggtgctatccccaaactgccactctaaactcttgaagtaaataaataatctttgctggcaggactatgctgaatctccttaggcactctctaatcagatgtcctcggtcctcccaactcttagaccttttatacctgtttttctccttctcttattccatttagtttttcaattcatacaaaaccgtatccaggccatcactaataattctaaatgacgaatgtttcttctaacagtcccacaatatcaccccttaccacagaatcttccttcagcttaatctctccaattctaggttcccacgccgcccctaatcccgctcaaagcagccctgagaaacatcgcccattatctctccataccacccccaaaaattttcaccgtcccaacactttaccactatttcgttttatttttcttattaatataagacaggaatgtcaggcttctgagcccaagttaagccatcatatcccctgtgacctgcatgtagaccaccagatggcctattcctgccttaactgatgacattccaccacaaaagaagtgaaaatggcctgttcctgccttaaccgatgacattgtcttgtgaaattccttctcctggctcatcctggctcaaaaactcccccactgagtaccttgtgacccccactctgcccgccagagaacaactcccctttgactgtaattttcctttatctacccaaatcctataaaatggccctacccttatctccctttgctgactctctctttggactcagcccgcctgcatccaggtgactaaaagctttattgctcacacaaagcctgtggtctcttcacagggacacacatgaaagtgactagccctcccccacctgcccagcaatttactcttaaaaaggtggctgaagctaaaggcatagtcaaggttaatgctcctttttctttatcccaaatcagatagcgtttaggctctttttcatcaaatataaaaaacccagcccagttcatggctcgtttggcagcaaccctgagacgctttacagccctggaccctaaaaggtcaaaaggccgtcttattctcaatatacattttattacccaatctgctcccgacattaaataaaactccaaaaattaaattccagccctcaaaccccacaacaggacttaattcacctcacctttaaggtgtacaataatagagtagaggcagccaagtagcaacatattttggagttgcaattccttgcctccactgtgagacaaaccccagccacgtctccagcacacaagaacttccaaacgcctaaactgcagtggccaggcattcctccagaaccgcctcccccaggagcttgctacaagtgccagaaatctggccaccaggccaaggaatgcccgcagcccaggattcctcctaagctgtgtcccatctgtgtgggaccctactggaaatcagactgttcagctcacctggcagccactcccagagcccctggaactctggcccaaggctctctgactgaccccttcccagatgttctcggcttagcagctgaagactgatgctgtccgatcaccttggaagcccagtagaccatcacagacaccgagctttaggtaactctcacagtggagggtagtccgtcccgttcttaatcattatggaggatacacactccacattaccttcttttcaagggtctgtttcccttgcttccataactgttgtgggtactgacaggcttctaaacctcttaaaactccccaactctggtgccaatttagacaatactcttttaagagctctttttttagttatccccacctgcccagttcccttattaggccaagacactttaaattatctgcttccctgactatccctggactacagctacatctcattgccgcccttcttcccaatccaaagcctcctttgcgtccacctcttatatccccccaccttaatccacaagtataagatacctctactccctccttggcaaccgatcatgcaccccttaccatctcagtaaaacctaatcacctttaccctgctcaatgccaatatcccatcctgcagcactctttaaaaaggttaaagcctgttatcacttgcctgctacagcatggccttttaaagcctataaactctccttacaattcccccattttacctgtcctagaaccagacaaggcttacaggttagttcaggatctgagccttatcaaccaaattgttttgcctatccaccccatggtgccaaacccatatactctcctatcctcaatacctccctccacaacccattattctgttctggatctcaatccctttgcacccttcatcccagcctctcttcgctttcacttagactgacgctgacacccaacaggctcagcaaattacctaggctgtactgctgcaaggcttcacagacagcccccattacttcagtcaagcccaaatttcatcctcatctgttatctatctcggcataattctcataaaaacacacgtgctctcccttctcatcatgtctgactaatctcccaaacctcaatcccttacaaaacaacagctcctttccttcctgggcatggttagatactttcgcctttagatacctagttttgccatcctaacaaaaccattatataaactcacaaaaggaaacctagctgaccccatagatcctaaatcctttccccattcctctttccattccttgaagacagctttaaagactgcccccaccctagctctccctgactcatcccaacccttttcattacacacagccgaagtgcagggcagtgcagtcagaattcttacacaaggactgggattgcatcctgtagcctttttgtccaaacaacttgaccttactattttaggctggccatcatgtctccatgcagcggctgctgtcgctctaatacttttagaggcccttaaaatcacaaactatgctcaactcactctctacatctctcataatttccaaaatctattttcttcctcacactgatgcatataccttctgctccccggctccttcagctgtactcactctttgttgagtctcccacaattaccattgttcctggcccggacttcaatctggcctcccacattattcctgttaccacacctgactctcatgactgcatctctctgatccacctgatgttcatcccatttccccacatttccttcttccctgtttctcaccctgatcacacttggtttattgatggcagttccaccaggcctaatcgccacacaccagcaaaggcaggctatgctatagtacaagccactagcccgcctcttagaacctctcatttcctttccatcatggaaatccatcctcaaggaaataacttctcagtgttccatctgctattctactactcctcagggattattcaggacccctcccttccctacacatcaagctccaggattagcccccaccaaggactggcaaattagctttactcaacgtgccccaagtcagataactaaaatacctcttagtgtaggtagacactttcactggatgggtagaggcctttcctgcaggatctgagaaggccaccacagtcatttcttcccttctatcagacataattcctcagtttagccttcccacctctatacagtctgataacagaccagcctttattagtcaaatcagccaagcagtttttcaggctcttggtattcagtgaaacctttatatcccttacagtcctcagtcttcaggaaaggtagaacggactaatggtcttttaaaaacacacctcaccaagctcagccaccaacttaaaaaggactggacaatacttttacctctttcttttctcagaattcaggcctgtccttggaatgctacagggtacagcccatttgagctcctgtatggacactactttttattaagccacagtcccattgcagacaccagaccaacttagactgtgccccaaaaaacttgtcatccctactatcttctgtctcatcatactcgtattcaccattctcaactactcatacatgccctgctcttgtttacactgctggtttacactgtttctccaagccatcacagctgatatctcctggtgctatccccaaactgccactctaaactcttgaagtaaataaataatctttgctggcaggactatgctgaatctctttaggcactctctaattagatgtcctaggtcctcccaattcttagacctttaatacctgtttttctccttctcttattccatttagtttttcaattcatacaaaactgtatccaggccatcaccaataaatctaaatcacaaatgtttcttctaacagtcccacaatatcaccccttaccacaaaatcttccttcagcttaatctctcccactctaggttcccacgccgcccctaatcccgcttgaagcagccctgagaaacatcgcccattatctctccataccatcccccataattttcactgtcccaacactttaccactatttcgttttatttttcttattaatataagaagacaggaatgtcaggcctctgagctcaagctaagccatcatatcccctgtgacctgcacgtacacatccagatggttcctgccttaactgatgacattccaccacaaaagatatgaaaatggcctgttcctgccttaactgatggcattatcttgtgaaattccttctcctggctcatcctggctcaaaagctcccctactgagcactttgtgacccccattcctgcccgccagaaaacaacccccctttttcctttacctacccaaatcctataaaacggccccacccctatctcccttcgctgactctcttttcagattcagcctgcctgcacccaggtgattaaaagccttattgctcacacaaagcctgtttggtggtctcttcacacagacacgcatgaaa

SEQ ID NO: 373 - DNA, 2100 bp, Homo sapiens
tgcagtcagaattcttacacaagagccgggaccgcgccctgtagcctttttatgcaaacaacttgaccttactgttttagcctagccctcatgtctgcgtgtggtggctgctgctccttaatacttttagaggccctcaaaatcacaaactatgctcaattaactctctacaattctcataactttcaaaatctattttcttcctcccacctgacacatatactttttgcttcccagctccttcagctatactcactctttgttgagtctcccacaattaccattgttcctggcccggactttaatcgagcctcacacattattccggataccacacctgacccccatgactgtatctctctaatccacctgacattcaccccatttccccatatttccttctttcctgtttctcaccctgatcacatttggattattgatggcagttccaccaggcctaatcgccactcaccagcaaaggcaagctatgctatagtatcttccacatctatcattgaggctaccgctctgccccgctccactacctcttagcaagctgaactcattgcctcaactcaagccctcactcttgcaaaggaattacgcgtcaatatttatactgactctaaatatgccttctatgtcctgcaccaccatgctgttgtataggcagaaagaggtttcctcactacacaagggtcctccatcattaatgcctctttaataaaaacacttctcaaggccaatttacttccaaaggaagctggagtcattcactgcaagggccatcaaaaggcatcagatcccattgctcaggacaatgcttacgctgataaggtagctaaaagcagctagcgttccaacttctatccctcatggcagtttttctccttctcatctggccactcccacctactcccccactgaaacttccacctatcaatctcttctcacacaaggcaaatggttcttggaccaaggaaaatatctccttccagcctcacaggcccattctattctgtcatcatttcataacttcttctatgtaagttacaagccactagcccacctcttagaacctctcatttccttcccatggtggaaatctatccttaaggaaatcacttctcagtgttccatctgctattctactactcctcagggattgttcaggcccccccacccacttccctacacatgaagctcgggcatttggccccgcccaggaccggcaaattgactttactcacatgcctcgagttaggaaactaaaatacctcttggtctgggtagacactttcactggatgggtagaggcctttcccacagggtctgagaaggccaccgccgtcatttcttcccttctgtcagacagaattcctcagtttggccttcccacctctatacagtctgataatggaccaacctttattagtcaaatcacccaagcagtttttcaggctcttggtattcagtgaactaatggtcttttaaaaacacacctcaccaagctcagccaccaacttaaagaggactggacaatacttttaccacttgcccttctcagaattcgggcctgtccttggaatgctacagggtacagcccatttgagctcctgcatggacactcctttttattaggccccagtctcatcccagacaccagaccaacttggactgcgccccaaaaaacttgtcatccctactatcttctgtctagtcatacacctattcaccattctcaactacacataaatgccctgctcttgtttacactgccggtttacactgtttctccaagccatcacagctgatatctcccagtgctatccccaaaccagcactcttaactcttaaagtaaataaataatctttgctggcagggctatgctgaagctccttgggcactctaattggatgtcctgggtcctcccaattcttagtactttaatacctgtttctctccttctcttattccttttaggttttcaattcatacaaaaccgtatccaggccatcaccaataattctgtatgacaaatgtttcttccaacaaccccacaatatcgccccttaccacaaaaccttccttcagcttaa

SEQ ID NO: 374 - DNA, 257 bp, Homo sapiens
aattccagacattgtatgaggaagcattgcaaaactttctgttctgttagctgttgcctgtagcccccagtcatgttccccacgcttgctcgatctctcactaaactttcacgtagacccttagagttacaagcccttaaaagggccaagaatttctttttcagggacctcggttgcaagtctgccgaagttcccggcctaatacagcccttctttaatccggtgtctgagttttgtctgcggctcgtcctgctgca

SEQ ID NO: 375 - DNA, 6821 bp, Homo sapiens
gtcaggcctctgagcccaagctaagccatcatatcccctgtgacctgcacatacacatccagatggccagctcctgccttaactgatgacattccaccacgaaagaaatgaaaatggcctgttcctgccttaactgataacattatcttgtgaaattccttctcctggctcatcctggctcaaaagctcccttactgagcaccttgtacccccactcctgcctgccagagaacaacccccctttgactgtaattttcctttacctacccaaatcttataaaacggccccacccctatctccctttgctgactctcttttaggactcagcccacctgcacccaggtgattaaaagctttattgcaccaaacacaaagcctgtttggtggtctcttcacacggacgcaagtgaaatttggtgccgtgattcggatcaggggacctcccttgggaaatcaatcccctgtcctcctgctctttgttccatgaaaaagatccacctacgacctcgggtcctcagacccaccagtccaaggaacatctcaccaattttaaatcgggtaagcggcctcttcttactctcttctccaacctctctcactatccctcaaccactttctcctttcaatcttgtcgccacccttcaatctctcccttctcttaatttcaattcctttcattttctggtagagacaaaggagacacattttatccatggacccaaaactctggcgccggtcacggactcaggaaggcagccttcccttggtgtttaatcattgcagggacacctctctgattattaaaccacgtttcagaggtgtctgaccatgcagggacgcctgccttggtccttcacccttagcggcaagtcccgcttttctgggggaggggcaagaaccctgaccccttctctccctgtctctactgcttctctgcttttctggggggcaagaaccccccaatcccttatttccgtgccccgacctcttatctctgcaccctgatcccttatttctgtgcccccacctcttatctctgagccccaaccccttatttctgtgccccaaccccttttctgcttttctggaaggcaagaaccccccaaccccttctctccatgtctctaacccttctctgcttttctggagagcaagaacccccccccccaaccccttctctccgtgtctctaccccttctctgcttttctggagggcaagaaccccccccaaccccttccctccatgtctctactctctcttttttctgggcttgcctccttcactatgggcaaccttccaccctccattcctccctcttctcccttagcctgtgttctcaagaacttaaaacctcttcaactcacacctgacctaaaacctaaatgacttattttcttctgcaatgctgcttgaccccaatataaactcgacagtggttccaaacagccagaaaatggcacttttgatttttccatcctacaagatctagataattcttgtcgtaaaatgggcattcataaaatgggcaaacggtctgaggtgcctgatgtccaagcattcttttacatattgttccctccctactctctgttcccaatgtgactggtcccaaatcttccttctttccctcctgtttgttctctcagtcccaactccaagcattgctgagtctttctaatcttccttttctacagacccatctgacctctcccctcctccccaggctgctcctcacaattcttcctcagcctctgctccccatccctataatccttttatcacctcccctcctcacacccggtccagcttacagttttgttctgagactagccctcccccacctgcccagcaatttcctcttaaaaaggtggctgaagctaaaggcatagtcaaggttaatgctcctttttctttatcagacctctcccaaatcagttagcgtttaggctctttcatcaaatatgaaaaacccagcccagttcacggctcatttggcagcaaccctgagacgctttacagtcctggaccctaaaaggtcaaaaggccgtcttattctcaatatacattttattacccaatctactcctgacattaaataaaactccaaaaattaaattctggccctcaaaccccacaacaagacttaatctcaccttcaaggtgtacaataatagagtagaggcagccaagtagcaatgtatttctgagttgcaattccttgcctccactatgagacaaaccccagccacatctccagcacacaagaactccaaatgcccgaaccgcagctgccaggggttcctccagaatctcctcccccaggagcttgctacaagtgccagaaatctggccactgggccaaggaatgcccacagcccaggattcctcctaagctgcatcccatctgtgcgggaccccactgaaaatcagactgttcaactcacctggcagccactcccagagaccctggaactctggcccaaggctctctgactgactccttcccagatcttctcggcttagcagctgaagactgacactgcccgattgccttggaagcctacagaaccatcacagatgctctgggtaacactcacagtggagggtaagtccgtccccttcttaatcaatacggaggctacccactccacattgccttcttttcaagggcctgtttcccttacctctgtaactgctgtaggtattgatggccaggcttctaaacctcttaaaactccccaactctggtgccaacttagacaatacttttttaagccctcctttttagttatccccacctgcccagttcccttattaggctgagacactttaactaaattatctgcttccctgactattcctggactatagccacatctcattgccgcccttcttcccaatccaaaacctcctttgcgtcctcttcttgtatccccccaccttaacccacaagtgtgggatacttctactccctccttggctaccgatcatgcaccccttatcatctcattaaaacctaatcacccttactccactcaatgcctatatcccatcccgcagcacgctttaaaaagattaaagcctgttatcactcgcctgctacagcatggccttttaaagcctataaactctccttacaattcccccatttcacctgtcctagaaccagagaagccttacaggttagttcaggatctgagccttatcaaccaaattgttttgcctatccaccccatggtgccaaacccatatactctcctatcctcaatacctccctccacaacctattattctgttctgttctggatctcaaacatgctttctttactattcctttgcacccttcatcccagcctctcttcgctttcacttagactgaccctgacacccatcaggctcagcaaattacctgggctgtactgccgcaagacttcacagatagcccccattacttcagtcaagcccaaatttcatcctcatctgttacctctctcggcataattctcataaaacacatgtgctctccctgctgatcgtgtccaactaatctcccaatcctcaatctcttctacaaaataacaactcctttccttcctgggcatggttagatactgtcgactttagatatctggttttgccgtcctaacaaaaccattatataaactcacaaaaggaaacctagttgaccccatagatcctaaatcctttccccactcctctttctgttccttgaagacagctttagagactgcccccaccctcgctctccctgactcaccccaacccttttcattacccatagccgaagtgcagggctgtgcagtcagaattcttacacaaggaccacgaccacaccctgtagactttttatctaaacaacttgaccttactgttttgcccagccctcaagtctgcatgtggcagctgccactgctctaacacttttagaggcccttaaaatcacaaactatcctcaactgactctctacagttctcataactttcaaaatctatttacttcctcacacctgacacatatactgtctgctcccaggctccttcagctgtactcactctttgttgagtctcccacaattaccactgttcctggccgacttcaatccggcctcccacattattcctgataccacacctgacccccatgactgtatctctctgatccacctgacattcactccatttccccatattctttcatgttccttaccctgaacacacttggtttattgatggcagttccaccaggcctaatcgccactcaccagcaaaggcaggctatgctatagtatcttccacatctatcattgaggctactgctctgtctccctccactacctctcagcaagccgaactcattgccttaagtcaagccctcactcttgcaaaaggactaaacgtcaatatttatactgactctaaatatgccttccatatcctgcaccaccatgcaagaggtttcctcactacaccacggtcctctatcattaatgcctctttaataaaaatgcttctcaaagctgctttacttccaaaggaagctagggtcattcactgcaaaggccatcaaagggcatcagatcccagcactcaggacaatgcttatgctgataagatagctaaaaaagcagctagcattccaacttatatccctcactttcagtttttctccttcatatcagtcactctcacctactcccccgctgaaacttccacctatcaatctcttcccacacaaggcaaatggttcttagaccaagaaaaatatctccttccagcctcacaggcccattctattctgtcatcatttcataacctcttccatgtaagttacaagctgctagcccatctcttggaacctctcatttcctttccatcctataagtacatcctcaaggaaatcacttctcagtgttccatttgctattctactacccctcaggaattgttcaggcctcctccctttcctacacatcaagctcggggatttgcccctgcccaggactggcaaattgactttactcacatgccccgagtcaggaaactaaaatacctcttagtctgggtagacgctttcactggatgggtaggcctttcctacagggtctgagaaggccaccgctgtcatttcttcccttctctcagacataattcctcggtttggccttcccacctctatacagtccgatagcagaccagcctttattagtcaaatcagccaagcagtttttcaggctcttggtattcagtgaaacctttatatcccttatggtcctcggtcttcaggaaagtagaacggactaatggtcttttaaaaacacacctcaccaagctcagccaccaacttagaaaggactggacaatacttttaccactttcccttctcagaattcaggcctgtcctcagaatgctacagggtacagcccatttgagctcctgtatggacgctcctttttattaagccccagtctcattccagacaccagaccaacttggactgtgccccagaaaacttgtcatccctactatcttctgtctagtcatactcctattcaccgttctcaactactcatacatgccctgctcttgtttacactgctggtttacactgtttcttcaagccatcacagctgatatctcctggtgctatccccaaacagccactcttaacttttttttttttttttttttttttttttttttttttgagacggagtctcgctctgtcgcccaggctggactgcggactgcagtggcgcaatctcggctcactgcaagctccgcttcccgggttcacgccattctgcctcagcctcccgagtagctgggactacaggcgcccgccaccgcgcccagctaattttttgtatttttagtagagacggggtttcaccttgttagccaggatggtctcgatctcctgacctcatgatccacccgcctcggcctcccaaagtgctgggattacaggcgtaagccaccacgcccggccaactcttaaagtaaataaataatctttgctggcaggactatgctgaatctccttaagcactctctaattagatatcctgggtcctcccaattctcagacctttaatacctgtttttctcctcttattccatttagtttttcaattcacacaaaaccgtatccaggccatcaccaataattctaaatgacaaatgtttcttctaacagtcccacaatatcacctcttaccacaaaatcttccttcagcttaatctctcccactctaggttcccacaccaccccaatcccgtttgaagcagccttgagaaacattgcccattctctctccataccatccccccaaattttcgccgtctcaacactttaccactatttcattttatttttcttattaatataagaagacaggaatgtcaggcctctgagcccaagctaagccatcatatcccctgcgacctgcacgtacacatccagatggccagctcctgccttaactgatgacattccaccacaaaagaaatgaaaatggcctgttcctgccttaactgattacattatcttgtgaaattccttctcctggctcatcccagctcaaaagttcccctactgagcaccttgtgacccccactcctgcctgccagagaacaacccccctttgactgtaattttcctttacctacccaaatcttataaaacagccccacccttatctcccttcgctgactctcttttcggactcagcccgcctgtacccaggtgattaaaagctttattgctcacaaaaagcctgtttggtggtcttttcaca

SEQ ID NO: 376 - DNA, 823 bp, Homo sapiens
agtgaagaagtgaaatctgggctgcactaaccaatggaaattacttaaaacccttcaccaaacctttcacttaggcattgatagcacccagacgcccaaattattatttactggaccaggccttttcaaaactatcaagcagatagtcagggcctgtgaagtgtgccaaagaaataatcccctgcactgcaggccatacatttcaatccctgtatctttaacctccttgttaagtttgtctcttccagaatcgaagctgtaaaactaaaaatgttcttcaaatggagccccagatgcagtccatgaataagatctaccgtggacccctggaccggcctgctagcccatgctccaatgttaatgacattgaaggcacccctcccgaggaaatctcaactacacaacccctactacacctcaattcagcaggaagaagttagagcggtcgttggccaacctcgccaacagcacttaggttttcctgttgagagggggtactaagagacaggactagctggatttcctagggtgactaagaatccctaagcctagctgggaaggtgaccacatccacctttaaacatggggtttgcaacttagctcacacccgaccaatcaggtagtaaagagagctcactaaaatgctaattaggcaaaaacaggaggcaaagaaatagccaatcatctattgcctgagagcacagtgggaaggataatgactgggatataaacccaggcattcaagccagcaatggctaccctctttgggtcccctccctttgtatgggagctctgttttcactccattaaatcttgcaactgc

SEQ ID NO: 377 - DNA, 4472 bp, Homo sapiens
tcaggcctctgagcccaagctaagccatcatatcccctgtgacctgcacgtacacatccagatggccggttcctgccttaactgatgacattccaccacaaaagaaatgaaaatggtctgttcctgccttaactgatggcattatcttgtgaaattcctgctcctggctcatcctggctcaaaatctcccctactgagcaccttgtgaccgcccccccactcctgccagccagagagcaacccccctttttcctttacctacccagatcctataaaacggccccaccccatctcccttcgctgattctcttttcagactcagcccacctgcacccaggtgaaataaacagctttattgctcacacaaagcctgtttggtggtctcttcacggggacacgcatgaaatttggtgctgtgattcagactgggggacctcccttgggagatcaatcccctgtcctcctgctctttgctccgtgagaaagatccacctacaacctctggtcctcagaccaaccagccgaaggaacatctcaccaattttaaatctggtaagcagcctctttttactctcttctccaacctctctcactatcccgcaacctctttctcctttcaatcttggcgccacacttcaatctctcccttctcttaatttcaattcctttcattttctggtagagacaaaggagacacgttttatctgtggacccaaaattccggcgctggtcacggagtagggaaggcagccttcccttggtgtttaatcattgcagggacacctctctgattattattcacccaggtttcagaggtgtcagaccatgcagggacacctgccttggtcctttacccttagtggcgagtcctgcttttctgagggaggggcaggaaccctgacctcttatctctatgccccaatcccttatttccatgccccaacctcttatctctgtgccccatccattatttccacaccctgacatcttatctctgtgccccaaccccttatttccatgccctgaccccttctctgcttttctggaaggcaagaaccccccacgccttctccgtgtctctactgtcttttctctaggtttgcctccttcactatgggcaagcttccaccttccattccttctgcttctcccttagcctgtgttcttaagaacttaaaacctcttcaactctcgcctgacctaaaatctaagtgtcttattttcttctgcaatcccacttgacctcaatacaaacttgacagtagttccaaatagccaaaaaaaatggcactttcaatttttccatcctacaagatctaaataattctttgtcataaaatgggcaaatggtctgaggtgcctgatgtccaggcattcttttagatgtcgggcccttcctagtctctcttcccaatgcaacttgtcccaaatcttccttctttccctcccgcctgtcccctcagtcccaaccccaagtgtcactgagtcttccagatcttccttttctgcatacctagctgacctctcccctcctcaccaagctgagctaagtcccaattcttcctcagccttcgctcctccacctataatccttttatcacctcccctcctcacacctggtctcgcttacagtttcgttctgtgactagccctcccccacctgcccagcaatttcctctgaaaaaggtggctggagctactaaaggtataatcaaggttaatgctcctttttctttttcccaaatcagatagcatttaggctctttttcatcaaatataaaaatccagcccagttcatggctcatttggcagcaaccctgagacactttacagccctagaccctaaaaggtcaaaaggccatcttattctcaatatacattttatcacccaatctgctcccgacattaaataaaactccaaaaattaaattccggccctcaaaccccacaacaggacttaattaaccttgccttcagggtgtacaataatagagtagaggcagccaagtagcaacatatttctgagttgcaattccttgcctccactgtgagacaaaccccagccacatctccagcacacaagaacttccaaacacctaaaccgcagtggccaggcattcctccagaaccgcctcccccaggagcttgctacaagtgccagaaatctggccaccaggccaaggaatgcccgcagcccaggattcctcctaagctgtgtcccatctgtgcaagaccccactggaaatcggactgttcaactcacctggcagccactcccagagcccctggaactctggcccaaggctctctgactgactccttcccagatcttctcagcttagcagctgaagactgatgctgcccgatcgccttggaagccctgtagaccatcacagatgccgagttttaggtaactctcacagtggagggtaagtccttccccttcttaatcaatatggaggccacccactccacattaccttgttttcaagggctgtttcccttgcctccataactgttgtaggtattgacagccaggcttctaaacctcttaaaactccccaactctggtgccaacttagacaatactcttttaagcactcctttttagttatcccacctgcccagttcccttattaggccaagacactttaactagattatctgcttccctgactattcctggattacagctacatctcattgccacccttcttcccaatccaaagcctcctttgcgtcctcctcttttatccccccaccttaacccacaagtataagatacctctactccctcctaggtgactgatcatgcaccgcttaccatctcattaaaacctaatcacccttaccccgctcaatgccaatatcccatcccacagcatgctttcaaaggattaaagcctgttatcactcgcctgctacagcatggccttttaaagcctataaactctccttacaattcccccattttacctgtcctaaaaccagacaagccttacaagttagttcaggatctatgccttatcaaccaaattgttttgcttatccaccccatggtgccaaacccatatactctcctatcctcaatacctccctccaaaatccattattctgttctagatctcaaagatgctttctttatattcctttgcacccttcatcccagcctctctttgctttcacctggactgaccctgacacccatcaagctcagcaaattacctaggctgtactgccgcaaagcttcacaggcagtccccattacttcagtcaagcccacgtttcttcctcatctgttacctatcttggcataattctcataaaaacacacgtgctctccctgctgatcatgtccagctaatctcccaaaccccaatcccttctacaaaacaacaactcctttccttcctgggcatagttagatactttcgcctttggatacctggttttgccatcctaaaaaaaccattatataactcacaaaaggaagcctagctgaccccatagatcctaaatcctttccccactcctctttccattccttgaagacagctttagagactgaccccaccctagctctccctgactcatccaacccttttcattacacacagctgaagtgcagggctgtgtattcagaattcttatgcaaggactgggatcacattctgtagcctttttgtccaaacaacttgaccttactgttttaggctggccatcttatctccgtgcagtggctgctgctgccctaatacttttagaggcccttaaaatcacaaactatgcacaactcactctctacagctctcctaatttccaaaatctgttttcttcctcacacctgacacatatactttctgctccctggctccttcagctgtactcactctttgttgagtctcccacaattaccattgttcctggccaacttcaatctggcctcccacattattcctgataccacacctgaccctcatgactgcatctctctgatccacctgacgttcaccacatttccccacatttccttcttccctgtttctcaccctgatcacacttggtttattgatgacagttccaccaggcctaatcgccacacaccagcaaaggcaggctatgctatagtacaagccactagcccgcctcttagaacctctcatttcctttccatcgtggaaacctatcctcaaggaaataatttctcagtgttctatctgctgttctactactcctcaaggattattcagggcccctcccttccctacacatcaagctcaaggatttacccctgcccaggactggcaaattagctttactcaacatgccctgagtcaggaaactaaaatacctcttggtctaggtagacactttcactggataggtagaggcctttcccacagggtctaagaaggccaccatggtcatttcttcccttctgtcagacataattcctcagtttggccttccca

SEQ ID NO: 378 - DNA, 5785 bp, Homo sapiens
gtcaggcctctgagcccaagccaagccatcacatcccctgtgacctgcacgtatatgcccagatggcctgaagtaactaaagaatcacaaaagaagtgaatatgccctgccccaccttaactgatgacattccaccacaaaagaagtgtaaatggccagtccttgccttaactgatgacattaccttgtgaaagtccttttcctggctcatcctggctcaaaaagcacccccactgagcaccttgcgaccccaactcctgcgcactgagcaccttacgacccccactcctacccgccagagaacaaaccccctttgactgtaattttcctttacctacccaaatcctataaaacggccccacctttatctccctccgctgactctcttttcggactcaggcgcctgcacccaggtgaaataaacagccatgttgctcacacaaagcctgttttgtggtctcttcacacggacgcgcatgaaatttggtgccatgactcggatcgggggacctcccttgggagatcaatcccctgtcctcctgctctttgctccgtaagaaagatccacctacgacctcaggtcctcagacctaccagcccaggaaacatctcaccaatttcaaatccggtaagcggcctctttttactctcctctccaacctccctcactatccctcaacctctttctcctttcaatcttagcgccacacttcaatctctcccttctcttaatttcaattcctttcattttctggtagagacaaaagagacatgttttatccgtgaacccaaaactccggcgccggtcacagactgggaaggcagccttcccttggtgtttaatcattgcagggacgcctctctgattatacactcatgtttcaagggtgtcagaccacgcagggacacctgccttggtccttcacccttagcggcaagtcccgctttcctggggcaggggcaagtacccctcaaccccttcttcttcacccttagaggcaagtcctgctttcctagggggcaagaagcccccaatcgcttatttccgcaccccaacctcttatctctgtgccccaatcccttatttccgtaccctgacctcttatctctgtgccccaatcccttatttccatgccccaaccccttttctgcttttctggagggcaagaaccccccaccccttctccgtgtctctactcttttctctgggcttgcctccttcactatgggtaagcttccaccttccattcctccttcttctcccttagcctgtgttctcaaaaacttaaaacctcttcaactcacacctgacctaaaacctaaatgccttattttcttctgcaatgccgcttgaccccaatacaaactcgacagtagttccaaatagccagaaaatggcactttgaatttttccatcctgcaaaatctaaataattcttttcgtaaaataggcaaacggtctgaggtgcctgacatccaggcattcttttacacatcagtcccttcctagtctctgtgcccagtgcaactcgtcccagatcctccttctttccctcccgcctgtcccctcagtcccaaccccaagcatcgctgagtcttcccagtctttcttttctacagacccatctgacctttcccctcctccccaggctgctcgtcgccaggctgagctaagtcccaatacttcctcagcctccactcctccaccctataatccttctatcacctcccctcctcacacccggtccggcttacagtttagttccacaactagctcttccccacctgcccagcaatttactcttaaaaaggtggctagagccaaaggcataatcaaggttaatgctcctttttctttatcccaaatcagatagcgtttaggctctttttcatcaaatataaaaacccagcccagttcatggctcgttcggcagcaaccctgagacactttacagccctagaccctaaaaggtcaaaaggccatcttattctcaatatacattttattacccaatctgctcccgacattaaataaaactccaaaaattaaattccagccctcaaaccccacaacaggatttaattaacctcgccttcaaggtgtaaaataatagaaaaaagttgcaattccttgcctccactgtgagacaaaccccagccacaatctccagcacacaagaacttccaaatgcctgaaccgcagtggccaggcgttcctccagaacctcctcccacaggagcttgctacatgtgccggaaatctggccactgggccaaggaatgcccgcagcctaggattcctcctaagccatgtcccatctgtgtgggaccccactgaaaatcggactgttcaactcacctggcagccactcccagcttccctggaactctggcccaagcctctctgactgactccttcccagatcttctcggcttagcagctgaagactgacactgcctgatcgcctcgggagccccctagaccatcacggacgccgagcttcgggtaactctcacagtggagggtaagcccgtccccttcttaatcaatacggaggctactcactccacattaccctcttttcaagggcctgtttcctttgccgccataactgttgtgggtattgacggccaggcttctaaacctcttaaaactccccaactctggggccaacttagacaatactcttttaagcactcctttttagttatccccacctgcccagttcccttattaggctgagacactttaactaaattatctgcttccctgactattcctggactacagctgtatctcattgccgcccttcttcccaatccaaagcctcctttgcgtcctccaaagcctcctttgcgtcctcctcttctatcccccaaccttaacccacaagtataagatacctctactccctccttggcgactgatcatgcaccccttaccatctcattaaaacctaatcactcttaccccactcaacaccaatatcccatcccgcagcatgctttaaaaagattaaaggctgttatcactcgcctgctacagcatggccttttaaagcctataaactctccttacaattcccccattttacctgtcctaaaaccagacaagccttacaagttagttcaggatctgcgccttatcaaccaaattgttttgcctatacaccccatggtgccaaacccatatactctcctatcctcaatacctgcctctacaacccattattctgttctggatctcaaacatgctttctttactattcctttgcacccttcatcccagcctctctttgctttcacttagactgaccctgacacccattaggctcagcaaattacctgggctgtactgccacaaggcttcacagacagcccccattacttcagtcaagcccaaatttcatcctcatctgttacctatctcggcataattctcataaaaacacacgtgctttccctgccgatcctgtccgattaatctcccaaacctcaatcccttacaaaacaacaactcctttccttcctaggcatggttagtgtggtcagaattcttacacaagagccaagaccgcaccctgtagcctttctgtccaaacaacttgaccttactgttttagcctagccctcatgtctgtgtgcagcagctgccgctgctttaatacttttagaggccctaaaaatcgcaaactatgctcaactcactctctacatttctcataacttccaaaatctattttcttcctcatacctgacgcatatactttctgctccccggctacttcagctgtacccactctttgttgaggctcccacaattaccgttgttcctggcccagacttcaatccagcctcccacattattcctgataccacacctgacccccatgactgtatctctctgatccacctgacattcaccccatttccccaaatttccttctttcctgttcctcaccctgatcacgcttgatttattgatggcggttccaccaggcctaatcgccacacaccagcaaaggcaggttatgctatagtacaagccactagcccgcctcttagaacctctcacttcctttccatcgtggaaatctatcctcaagcaaataacttctcagtgttccatctgctgttctactactcctcagggattattcaggacccctcccttccctacacatcaagctccaggatttgccccacccaggactggcaaattagctttactcaacatgccctgagtcagataactaaaatacctcttagtctaggtagatactttcactggataggtagaggcctttcctacagggtctgagaaggccaccgcagtcatttcttccattctgtcagacataattcctcagtttagccttcccacctcaatacagtctgataacagacgagcctctattagtcaaatcagccaagcagtttttcaggctcttagtattcagtgaaacctttatatccctttatggtcctccatcttcaagaaaagtagaatggactaaaggtcttttaaaaacacacctcaccaagctcagccaccaacttaaaaaggactggacaatacttttaccactttcccttctcagaattcaggcctgtcctcggaatgctacagggtacagcccatttaacgtcctgtatagacgctcctttttattaggccccagtctcattccagacaccagaccaacttagactgtgcctcaaaaaaaaaaaaaaacttgtcatccctactattttctgtctagtcatactcctattcaccgttctcaactactcatacatgccctgctcttgtttacactgccggtttacactgtttttccaagcgatcacagctgatatctcctggtgctagccccaaactgccactcttaactcttgaagtaaataaataatctttgctggcaggactatgccaaatctccttaagcactctctaatcagacctcctgagtcgtcccaattcttagaccttttatacctgtttttctccttctgttattccatttagtttttcaattcatacaaaaccgtatccaggccatcaccaatcactctatatgacaaatgtttcttctaacatccccacaatatcaccccttaccacaagacctcccttcagcttaatctctcccactctaggttcccacgccgcccctaatcccgcttgaagcagccctgacaaacatcatccattctctctccataccaccccccaaaaattttcgccgccccaacactgcaacactattttgttttatttttcttattaagaaggcaggaatgtcaggcctctgagcccaagccaagccatcacatcccctgtgacctgcacgtatatgcccagatggcctgaagtaactaaagaatcacaaaagaagtgaatatgccctgccccaccttaactgatgacattccaccacaaaagaagtgtaaatggccagtccttgccttaactgatgacattaccttgtgaaagtccttttcccggctcatcctggctcaaaagcacccccactgagcaccttgcgaccccaactcctgcgcactgagcaccttacgacccccactcctacccgccagagaacaaaccccctttgactgtaattttcctttacctacccaaatcctataaaacggccccacccttatctccctccgctgactctcttttcggactcagcccgcctgcacccaggtgaaataaacagccatgttgctcacacaaagcctgtttggtggtctcttcacatggacgcgcatgaaa

SEQ ID NO: 379 - DNA, 9462 bp, Homo sapiens
gtggggaaaagaaagagagatcagattgttactgtgtctgtatagaaagaagcagacataggagactccattttgttctgtattaagaaaaattcttctgccttgagatgctgttaatctataaccttacccccaaccccaggctctctgaaacacatgctgtgtcaactcagggttaaatggattaagggctgtgcaggatgtgctttgttaaacagatgcttgaaggcagcatgctccttaagagtcatcaccacgccctaatctcaactacccagggatacaaacactgcagaaggccacagggacctctgcctaggaaagccaggtattgtccaaggtttctccccatgtgatagtctgaaatatggcctcgtgggaagggaaagacctgaccgtcccgcagctcgacacccgtaaagggtctgtgctgaggaggattagtataagaggaaggcatgcctctttgcagttgagacaagaggaaggcatctgtctcctgcctgtccctgggcaatggaatgtctcggtataaaacccaattgtatgttccatctactgagataggggaaaaccgccttagggctggaggtgggacatgtgggcaacaatactgctctgtaaggcattgagatgtttatgtgtatgcatatctaaagcacagcacttaattctttaccttgtctatgatgcagagacctttgttcacctgtttatctgctgaccttctctccactattatcctatgaccctgccacatccccctctctgagaaacacccaaaaatgatcaataaatactaagggaactcagaggctggcgggatcctccgtatgctgaatgctggtcctctgggcccccttattcctttctctatactttgtctctgtgtctttttcttttccaagtctcttgttctacctaacaagaaacacccacaggtgtggaggggcaacccaccccttcatctggtgcccaatgtgggggcttttctctagggtgaaggtacgctcgagcatggtcattgaggacaagtcgacgagagatcccgagtacgtctacagtcagccttacagtgcgctcggacgaagctagggtgacaatggggcaaattaaaggaaaactaaaaataaatatgccttttatctcagctttattaaaattcttttaaaaagagtgggagttagagtatctacaaaaaatctaatcaagctatttcaaacaatagaacaattttgcccatggtttccagaacaaggaactttagatctaaaagaagactggaaaagaattggcaaggaactaaagcaggtaggaagggtaatatcattccacttacagtatggaatgattgggccattattaaagcagctttagaacgatttcaaagagaagaagatagtgtttcagtttctgatgcccctggaagctgtgtaatagattgtaaagacaagacagggaaaaaatcccagaaagaaacggaaagtttacattgcgaatatgtagcagagccagtaatggctcagtcaacgcaaaatgttgactataatcaatcaattacagggggtgatatatcctgaaacattaaaattagaaggaaaaggtccagaattagtggggccatcaaagtctaaaccacgaggaccaagtcctcttccagtaggtcagatgcccgtaacattacaacctcaaacgcaggttagagaaaataagacccaactaccagtagcttatcaatactggccaccggccaaacttcagtatcggccacccccagaaagtcagtatggatatccaggaacgctcccagcaccacagggcagggcgccataccctcagccacccactagcagacttaatcatacggcaccacctagtagacagggtagtgaattacatgaaattattgataagtcaagaaaggaaggagacactgaggcgtggcaattcccagtaacgttagaaccgataccacctggagaaggagcccaagagggagagcctctcacagttgaggccagatacaagtctttttcgataaaaatgctaaaagatatgaaagagggagtaaaacactatggacccaactccccttatatgaggacattattagattccattgctcatggacatcatagactcattccttatgattgggagattctggcaaaatcgtctctctcaccctctcaatttttacaatttaagacttggtggattgatggggcacaagaacaggtctgaagaaatagggctgccaatcctccagttaacaaagatgcagatcaactgttaggaacaggtcaaaattggagcactattagtcaacaagcattaatgcaaaatgaggccattgagcaagttagagctatctgccttagagcctgggaaaaaatccaagacccaggaaccgcctgcccctcatttcatacagtaagacaaggtttgaaagagccctaccctgattttgtggcaaggttccaagatgttgctcaaaagtcaattgctgatgaaaaagcccgtaaggtcatagtggagttgatggcatacgaaaacgccaatcctgagtgtcaatcagccattaagccattaaaaggaaaggtttccacaggatcagatgtaatctcagagtatgtaaaagcctgtgatggaattggaggagctatgcataaagctaagcttatggctcaagcaatagtgggagttgttttagaaggacaagttagaacatttggagggaaatgttataattgtggtcaaattggtcatttaaaaaagaattgcccagtctcaaataaacagaatataactattcaagcgactacaacaacaggtagagagccaccagacttatgtccaagatgtaaaaaaggaaaacattgggctagttaatgtcattctaaatttgatagaaatgggcaaccattgtcaggaaacgagcaaaggggccagcctcaggccccacaacaaactggggcattcccaattcagccctttgttcctcagggttttcagggacaacaacccccactgtcccaagtacctcagggaataagccagttaccacaatacaacaattgtcccccgccacaagtggcagtgcagcagtagatttatgtactatacaagcagtctctctgcttccaggggagcccccacaaaaaatccccacagggttatatggcctgctgcctgagggtactgtaggactaatcttgggaagatcaagtataaatctaaagggagttcaaattcatacttgtgtggttgattcagactataaaggcaaaattcaattggttattagctcttcaattccttggagtgccactccaggagacaggatttttccatttttactcctgccttatattaaggttggaaatagtgagataaaaagaacaggagggtttggaagcactgttccaacaggaaaggctgcatactgggcaagtcagatctcagagaacagacctgtgtgtaaggccattattcaaggaaaacagtttgaagggttggtagacactggggcagatgtctctatcattgctttaaatcagtggccaaaaaattggcctaaacaaaaggctgttacgggacttgtcggcgtaggcacagcctcagaagtgtatcaaagtactgagattttacattgtttagggccagataatcaagaaagtactgttcagccaatgattacttcaactcctcttaatctgtggggtcaagatttattacaacaatggggtgtggaaatcaccatgcccgctccattatatagccccacgagtcaaaaaatcatgaccaagatgggatatataccaggaaagggactaggaaaaaatgaagatggcattaaagttccagttgaggctaaaataaatcaagaaagagaaggaattagggtatccttgttaggggcggccactgtagagcctcctaaacccataccattaacttggaaaacagaaaaaccagtatgggtaaatcagtggccgctaccaaaacaaaaactggaggctttacattcattagcaaatgaacagttcaaaaagggacatattgagccttcattctcgccttggaattctcctgtgtttgtaattcagaagaaatccagcaaatggtgtatgttaactgacttaagggccgtaaatgccgtaaatcaacccatggggcctctccaacccggattgccctctctggccatgatcccaaagactggcctttaattataattgatctaaaggactgcttttttaccatccctctggcggagcaggattgcgaaaaatttgcctttactataccagccataaataataaagaaccagccaccaggtttcagtggaaagtgttacctcagggaatgcttaatagtccaactatttgtcagacttttgtaggtcgtgctctttaaccagttagagacaagttttcagactgttattcattatattgatgatattttgtgtgctgcagaaacaagagataaattaattgacttatacatttctgcaagcagaggttgccaacgcaggactggcaatagcatctgataagactcaaacctctactccttttcattatttagggatgcagatagagaatagaaaaattaagccacaaaaaatagaaataagaaaagacacattaaaaacactaaatgattttcaaaaattgctgggagatattaattggattcggccaactctaggcattcctacttatgccatgtcaaatttgttctctatcttaagaggagactcagacttaaatagtaagagaatgttaaccccagaggcaacaaaagaaattaaattagtggaagaaaaaattcagtcagcgcaaataaatagaacagatcccttagccccactccaacttttgatttttgctactgcacattctccaacaggcatcattattcaaaatactgatcttgtggagtggtcattccttcctcacagtacagttaagacttttacattgtacttggatcaaatagccacattaattggtcagacaagattatgaataataaaattatgtggaaatgacccagacaaaatagttgtccctttaaccaaggaacaaattagacaagcctttatcaattctggtgcatggcagattggtcttgctaattttgtgggaattattgataatcattacccgaaaacaaaaatcttccagtttttaaaactgactacttggattctacctaaaattaccagatgggaacttttagaaaatgttctaacagtatttactgatggttccagcaatggaaaagtggcttacacagggccgaaagaatgagtaatcaaaactccatatcaatcggctcaaagagcagagttggttgcagtcattacagtgttacaagattttgatcaacctatcaatattgtatcagattctgcatatgtagtacaggctacaagggatgttgagacagctctaatcaaatatagcatggatgatcagttaaaccagctattcaatttattacaacaaactgtaagaaaaagaaatttcccattttatattactcatattcgagcacacactaatttaccagggcctttgactaaagcaaatgaacaagctgacttactggtatcatctgcattcataaaagcatgagaacttcatgctttgactcatgtaaatgcagcaggattaaaaaacaaatttgatgtcacatggaaacaggcaaaagatattgtacaacattgcacccagtgtcaagtcttacacctgcccactcaagaggcaggagttaatcccagaggtctgcgtcctaatgcattatggcaaatggatgtcacgcatgtaccttcatttggaagattgtcatatgttcatgtaacagttgatacttattcacatttcatatgggcagcttgcgaaacaggagaaagtacttcccatgttaaaaaacatttattatcttgttttgctgtaatgggagttccagaaaaaatcaaaactgacaatgggccaggatattgtagtaaagctttccaaagattcttaaatcggtggaaaatttcacatacaacaggaattccctataattcccaaggacaggccatagttgaaagaactaatagaacactcaaaactcaattagttaaacaaaaagaagggggagacagtaaagagtgtaccactcctcagatgcaacttaatctagcactctatactttaaattttttaaacatttatagaaatcagactactacttctgcagaacaacatcttactggtaaaaagaacagcccacatgaaggaaaattgatttggtggaaagataataaaaataagacatgggaaatagggaaggtgataacgtggggaagaggttttgcttgtgtttcaccaggagaaaatcagcttcctgtttggatacccactagacatttgaagttctacaatgaacccatcggagatgcaaagaaaagcacctccgcggagacggagacaccgcaatcgagcaccgtcgagtcacaagatgaacaaaatgatgatgtcagaagaacagatgaagttgccatccaccaataaggcagagccgctgacttgggcacaactaaacaagctgacgcagttagctacaaaatgtctagagaacacaaagatgacacaaactccagagagtatgctgcttgcagcattgatgattgtatcaacggtggtaagtctccctatgcctgcaggagcagctgcagctaattatacctactgggcatatgtgcctttcccgcccttaatttgggcagtcacatggatggataatcctatagaagtatatgttaatgagagtgtatgcgtacctggccccacagatgatcgctgccctgccaaacctgaggaagaagtgatgatgataaatatttccactgggtatcgttatcctcctatttgcctagggagagcaccaggatgcttaatgcctgcagtccaaaattggttggtagaaggacctactgtcagtcccatcagtagaatcatttcttacatggtaagtgggatgtcactcaggccacgggtaaattatttacaagacttttcttatcaaagatcattaaagtttagacctaaagggaaaccttgccccaaggaaattcccaaaggatcaaaaaatacagaagttttagtttgggaagaatgtgtggccaatagtgcggtgatattacaaaacaatgaatttggaactattatagattgggcaccttgggtcaattctaccatgattgcacagggcaaactcagtcgtgtcccagtgcacaagtgagtccagctgttgatagcgacttaacagaaagtttagacaaacataagcataaaaaattatagtctttctatccttgggaatggggagaaaaaggaatctctaccccaagaccaaaaataagaagtcctgtttctggtcctgaacattgagaattatggaggcttacttagcctcataccacattagaatttggtctggaaatcaaactttagaaacaagggattgtaagccattttatactatcgacctaaattccagtctaacggttcctttacaaagttgcgtaaagaccccttatatgctagttgtaggaaatatagttattaaaccagactcccaaactataacctgtgaaaattgcagattgtttacttgcattgattcaacttttatttggcagcaccgtattctgctggtgagagcaagagaaggcatgcggatccctgtgtccatggaccaaccgtgggaggcctcgccatccgtccatgttttgactgaagtattaaaaggcattttaaatagatccaaaagattcatttttactttaattacagtgattatgggattaattgcagtcacagctatggctgctatagcaggagttgcgttgcactcttctgttcagtcagtaaactttgttaatgattggcaaaagaattctacgagattgtggaattcgcaatctggtattgatcaaaaaatggcaaatcaaattaatgttcttagacaagctgtcatttggatgggagacaggctcatgagcttagaacatcgtttccagttacagtgtgactggaatacgtcagatttttgtattacaccccaagtttataatgagtctgagcatcactgggacatggttagacgccatctacagggaagagaagataatctcactttagacatttccaaattaaaagaacaaatttttgaaacatcaaaagcccatttaaatttggtgccaggaactgaggcaatcgcaggagttgctgatggcctcgcaaatcttaaccctgtcacttgggttaagaccatcggaagtactatgattataaatttcatattaatccttgtgtgcctgttttgtctgttgttagtctgcaggtgtacccaacagctctgaagagacagtgaccattgagaacgggccatgatgacgatggctgttttgtcgaaaagaaaagggggaaatgtggggaaaagaaagacagatcagattgttactgtgtctgcatagaaagaagtagacacaggagactccattttgttctgtattaagaaaaattcttctgctttgagatgctgttaatctgtaaccttaccccaaccccgtgctctctgaaacacatgctgtgtcaactcagggttaaatggattaagggctgtgcaggatgtgctttgttaaacagatgcttgaaggcagcatgctcctttagagtcatcaccacgccctaatctcaactacccagggacacaaacactgcggaaggccacagggacctctgcctaggaaagccaggtattgtccaaggtttctccccatgtgatagtctgaaatatggcctcgtgggaagggaaagacctgaccgtcccccagcccaacacccataaagggtctgtgctgaggaggattagtataagaggaaggcatgcctctttgcagttgagacaagaggaaggcatctgtctcctgcccatccctgggcaatggaatgtctcggtataaaacccgattgtatgttccatctactgagataggggaaaaccgccttagggctggaggtgggacatgtgggcaacaatactgctctgtaaggcattgagatgtttatgtgtatgcatatctaaagcacagcacttaattctttaccttgtctatgatgcagagacctttgttcacgtgtttatctgctgaccttctctccattattatcctatgaccctgccacatccccctctctgagaaacacccaagaatgatcaataaatactaagggaactcagaggctggtgggatcctccgtatgctgaatgctggtcccctgggcccccttatttctttctctatactttgtctctgtgtcttttttcttttccaagtctgtcattccacctaatgagaaacacccacaggtgtggaggggcaacccaccccttca

SEQ ID NO: 380 - DNA, 7309 bp, Homo sapiens
cccctttgggtcccctccttatatgggagctctgttttcactctatttcactctattaaatcttgcaactgccctcttctggtccatgtttgttacggctcaaactgagctttcgctcgccgtccaccactgttgtttgccgccttcgcagacccgccgctgacacccatccctctgaatccggcagggtgtctgctgtgctcctgatccagtgaggcgcccattgccactcccgattgggctaaaggcttgccattgttcctgcatggctaagtgcctgggttcgtcctaatcgagctgaacactagtcactgggttccatggttctcttccgtgacccacgacttctaatagagctataacactcaccgcatggcccaagattccattccttggaatctgtgaggccaagaaccccaggtcagagaacacggggcttgccaccatcttggaagtggcccgccgccattttggaagtggcccaccaccatcttgggagctctgtgagcaaggaccccccggtaacattttggcgaccacgaagggacctccaaagcggtgagtaatatcggaccactttcacttgctattctgtcctatccttccttagaactggaggaaaataccaggcacctgtcggccagttaaaaacgattagcatggccacaggacttaagactcaggtgtgaggctatctggggaagggatttctaacaacccccaacccttctattggggacgttggtctgcctcgcgccggcttccactttcagttttcttggggaagccaagggccgcctagagacagaaagctgttgtcctgaactcccggcagtagccggttgagatcatggcacagccagaagtctctactcagcagtcgcctgtgcatgcgccccacctttccttctgacccatacctcctgggtcccgaccacgactttcttgaaagtgtagccccaaaattctccttacctctgaatctacttcctctgatccctgcctcctaggtactaatggttcagactttcatttcctctagcaagtcgtatctccaaggggatctaaggaagctctacgctgcgtccttaggcagctagactataacccaggcagtcttatccctggtgtccctcccgatttaggtatacagctcttgacatgggcagttatgggcagttatgtgggacccgttccccaccacccttgccagggccccaagtttgtaatggctaagagagagagactgagagagcgagagagagagacggagagagagagatggagagagggacaaagacagagtcaaagacagaaagaaagaaaaagatagaaatagttttaaaaaaaaagtgtgccctattcctttaaaagccagggtaaatttaaaacctgtaattgataattgaaggtcttctccgtgaccctataacacttcaatgccactttgttgtcaatgtaaataagggcgtagcccaaaagcactgaggccactgacaacctgtagctttcctatcaaaaatccttaacccagtaacccgcggatgggccaaatgcattcggtcggtagcggcaattgctttgctaaaagtagaaaaggaactttttgaggaaacttcgttgacagcacacctcaccagttaaactattctaagtcaaaaaaaaaaaaaaagcaaaaaggtagcttactaaatcaaaaatcttaaagtatggggctattgtgttagaaaagggtaatgtaactccaaccactgataattcccttaacccagcagatttcctaacaggggatttaaatcttaattaccatacaaaggtccgaccagacctaggaggaactcccttcaggaccggaggatagatggttcctcccaggcgattgaggagaaaaccacaatgggtattcagtaattgatacagagactggtgtggaagcagagtgagaaaaattgcctaataattggtctcctcaaacatgtgagctgtttgcactcagccaagccttaaagtacttacagaatcaaaagactatctcaatcctgaatcaaaaggttcgctacaccctctctgaaatgaatttacataagaattgttttttataggaatgcatcttgatggggcagctgggttgttatgaaatactcaagaacccagcccagctctaggactcacccctgagtgcaaaggcaatgttgggcacgctggcaaaggaccactagaatccagcagcccagacccctttgtttgtggtcaagagaggcgggaaaacaggtgcaggactgctacattggtgagcataactaatccgataagcagaggtccatgggtggttacgcaccctggaaaggatctcacccctgagcccaaaggcaatgttgggcacgctggtaaaggaccactagaatccagcagcccggacccctttctttgtggtcaagagaggcgggaaaacaggtgcagaactgctacatcagttagcataactaatccaataagcagaggtccatgggtggttatgcaccctggaaaagaataaacattaggcccttagaggatgctctaggactaacgctcgatggaaaatgactaagggtgctggcacccctatgtccttttttcagatgggaaatgttccccccaccccaaggcagaaatgcccctgagatgtattctggagaattaggaccaatttgaccctcagacgctaagaaagaaatgacttatattcttctgcagtaccgcctggccacgatatcctcttcaaggggcagaaacttggcctcctgagggaagtataaattataacaccatcttacagccagacctcttctgtagaaaggagggcaaatggagtgaagtgccatatttgcaaactttcttttcattaagagacaactcataattatgtaaaaagtgtggtttatgtcctacaggaagccctcagattctacctccctatcccagcatccccctgactccttccccaaataataaggaccccccttttacccgaatggtccaaaggagatagacaaatggataaacgatgaacaaaacagtgccaatattccctgattttgccccctccaagcagtgggaggaggagaatttggcccagccagagagtgcatgtatctttttctctctcagacttaaagcaaattaaaatagacctaggtaaattctcagataaccctgatggctatattgatgttttacaaaggttggggcaatcctttgatctgacatggagagatatcatgttactgctaaatcagacactaaccccaaatgagagaagtgccgccataagtgcagcctgagagtttggcaatctctggtatctcagccaggtcaatgataggatgacaacagaggaaagaacgattcaccacaggccagcaggcagttcccagtgtagaccgtcactgggacacagaatcagaacatggagattggtgccacagacattcgctaacttgcgtgctaggactaaggaaaactaggaagaagcttatgaattattaaatgatatccactataacacccactataacagggaaaggaagaaaatcctactgcctttctggagagactaagggaggcattgaggaagcatacctctctgtcacctgactctattgaaggccaactaatcttgaatgataagtttatcactccgtcagctgcagacattagaaaaaacttcaaaagtccaccttaggcccagagcaaaacttagaaaccctattgaacttggcaacctcggttttttataatagagatcaggaggagcaggcagaatgggacaaacgggatttaaaaagggccaccgctttagtcacggccctcaggcaatcagactttggaggctctggaaaagggaaaagctgggcaaatcaaatgcctaatagggcttatttccagtgtggtctacaaggacactttaaaaaagattgtccaagtagaaataagccaccccctcgtccatgccccttatgtcaagggaatcactggaagacccattgccccaggggatgaaggtcctctgagtcagaagccactaaccagatgatcctgcagcaggactgagggtgcccagggcaagcaccagcccatgccatcaccctcatagagccctgggtatgcttgaccattgagggccaggaggttaactgtctcctggacactggcacggccttctcagtcttactcgcctgtcccggacaactgtcctccgcatctgtcactatccaaggggtcctaggacaggcagtcactagatacttctcccagccactaaattgtgactggggaactttactcttttcacatgcctttctaattatgcctgaaagccccactcccttgttagggagagacattgtagcaaaagcaggggccattatacatctgaacgtaggaaaaggaacacctgtttgttgtcccctgcttgaggaaggaattaatcctgaagtctgagcaacagaaggacaacatagatgagcaaagaatgcccatcctgttcaagttaaactaaaggattccacctcctttccttactgaaggcagcaccccctcagacccgaggcccaacaaggactccaaaagattgttaaggacctaaaagcccaaggcctagtaaaaccatgcaatagcccctgcaatactccaattttaggagtacagaaacccaatggacagtggaggttagtgcaagatctcaggattatcaatgaggctgttgttcctctatacccagctgtacctaacccttatactctgctttcccaaataccagaggaagcagagtggtttacagtcctggaccttaaggatgcctttttcggcatccctgtacatcctgactctcaattcttgtttgcctttgaagatccaatgtctcaactcacctggactgttttaccccaagggttcaaggatagcccccgtctatttggccaggcattagcccaagacttgagccaattgtcatagctggacattcttgttcttcagtatggggatgatttaattatagccacccattcagaaaccttgtggcatcaagccacccaagcgctcttaaatttcctcgctacctgtggctccaaacaaaaggctcagctctgctcacagcaggttaaatacttagggctaaaattatccaaagtcaccagggccctcagagaggaacgtatccagcgtatactggcttatcctcatcccaaaaccctaaagcaactaagagggttccttggcataacagccttctgccgaatatggattcccagatacagtgaaatagccaggccattatgtacattaattaaggaaactcagaaagccaatacccatatagtaagatggacacctgaaacagaagtggctttccaggccctaaagaaggccctaacccaaaccccagttgtaagcttgccaacggggcaagacttttctttatatgtcacagaagaaacaggaatagctctaggagtccttacgcaggtctgagggatgagcttgcaacccgtggtatacctgagtaaggaaattgatgtagtggcaaagggttggcctcattgtttatgggtaatggtagcagtagcagtcttagtatctgaagcagttaaaataatacagggaagagatctttctgtgtggacatctcatgatgtgaacggcatactcactgctaaaggagacttgtggctgtcagacaaccgtttacttaaatatcaggctctattacttgaagagccagtgctgcgactgcgcacttgtgcaactcttaacccagccacatttcttccagacaatgaagagaggaaagaacataattgtcaacaagtaattgctcaaacctatgccactcaaggggaccttttagaggtgcccttgactgatcacgacctcaacttgtatactgatggaagttcctttgtagaaaaaggacttcaaaaagcagggtatgcagtggtcagtcgtaatggaatacttgaaagtaatcccctcactccaggaactagtgctcagctggcaaaactaatagccctcactcaggcactagaattaggagaagggaaaagggtaaatatatatacagactctaagtatgcttacctagtcctccatgcccatgcagcaatatggagagaaagggaattcctaatttccgagggaatacctatcaaacatcaggaagccatcaggagattactattggctgtaccgaaacctaaagaggtggcagtcttacactgccggggtcaccaggaaggaaaggaaagggaaatagaaaggaaccaccaagcggatattgaagccaaaagagccacaaggcaggaccctccattagaaatgcttatagaaggacccctagtatggggtaatcccctccaggaaaccaagccccagtactcggaagaagaaatagaatgaggaacctcatgaagacatagtttcctcccctcaggatggctagccaccgaagaaggaaaaatacttatgcctgcagctaaccagtggaaattacttaaaacccttcaccaaacctttcacttatgcattgatagcacccatgagatggccaaattattatttactgcaccaggccttttcaaaactatcaagcagggcctctatagtgtgccaaagaaataatcccctgcattgcagaccatacatttcaatccctgtatctttaacctccttgttaagtttgtctcttccagaattgaaactgtaaaactacaaatcattcttcaaatggagccccagatgcagtccatgactaagatccactgcagacccctgatcaacctcctagcccatgctccaatgttaatgacattgaaggcacccctcccgaggaaatctcaactgcacaacccctactatgacccaattcagcaggaagcagttagagcagtcatcagccaacctccccaacagcacttgggttttcctgttgagaggggggactgagagacaggactagctggatttcctaggccgactaagaatccctaagcctagctgggaaggtgaccgcatctacctttaaacatggggcttgccacttagctcacacccaaccaatcagagagctcactaagaagctaattaggcaaaaataggaggtaaagaaatagccaatcatcaattgcctgagagcacagtgggagggacaaggatccggatataaacccaggcatttgagacagcaatggcaatcccctttgggtcccctccttgtatgggagctctgttttcactctatttcactctattaaatcttgcaactgca

SEQ ID NO: 381 - DNA, 971 bp, Homo sapiens
gtggggaaaagaaaaagagatcagactattactgtgtctatgtagaaagaagtagacataagagactacattttgttttgtattaagaaaaattcttctgccttgagatgctgttaatctgtaaccctacccccaaccctgtgctcacagaaacatgtgctgtgttgactcaaggtttaatgggtttagggctatgcaggatgtgctttgttaaagaaatgcttgaaggcagcatgcttgttaaaagtcaccacctctccctaatctcaagtacccagggacacaaaacactgcggaaggccaggccgcagggacctctgcctaggaaagccaggtattgtccaaggtttctccccatgtgatagtctgaaatatggcctcctgggaagagaaagacctgaccgtcccccagcccgacacccgtaaagggtctgtgctgaggaggattagtaaaagaggaaggcctctttgcagttgagatgagaggaaggcatctgtctcctgcccatccctgggcaatggggtgtctcggtgtaaaacccaattgtatgttccatctactgagataggagaaaactgccttaaggttggaggtgagacatgctggcagcaatacttctctttaatgcaccagatatgtttatgtatgtgcacatcaaagcacagcacattttctaaccttgtttatgacacagagacatttgttcacatgttttcctgatgacactctccccactataccctattgtcctgccacatccccctctctgagatggtagagataatgatcagtaaatactgagggaactcagagactggtgcccgcgtgggtcctctgtatgctaagcgccggtcccctgggcccagttttctttctctatactttgtctctgtgtctctttcttttctcagactctcgtcccccccagcgagaaacacccacaggtgtggaggggcaggccaccccttca

SEQ ID NO: 382 - DNA, 5827 bp, Homo sapiens
gtcaggcctctgagcccaagccaagccatcgcatcccctgtgacttgcacttatacgcccagatggcctgaagtaactgaagaatcacaaaagaagtgaatatgccctgccccaccttaactgatgacattccaccacaaaagaagtgtaaatggccagtccttgccttaagtgatgacattaccttgtgaaagtccttttcctcgctcatcctggctcaaaaagcacctccactgagcaccttgcgaaccccactcctgcccgccagagaacaaaccccctttgactgtaattttcctttacctatccaaatcctataaaacggcctcacccttatctcccttcgctgactctcttttcggactcagcccgcctgcacctgggtgaaataaacagccatgttgctcacacaaagcctgtttgatggtctcttcacatggacgcgcatgaaatttggtgccgtgactcggatcgggggacctcccttgggagatcaatcccctgtcctcctgttctttgctccctgagaaagatccacctatgacctcaggtcctcagaccgaccagcccaaggaacatctcaccaatttcaaatcaggtaagcggcctcttcttactctcttctccaacctctctcactgtccctcaaccactttctcctttccactcttcaatctctcccttctcttaatttcaattcctttcattttctgggagagacaaaggagacacattttatccgtggacccaaaactccggcgccggtcacggacagggaaggcagccttcccttggtgtttaatcattgcagggacgcctgattatacacccacgtttcaagggtgtcagaccacacagggacgcctgccttggtccttcacccttagcggcaagtcctgcttttctggggaaggggcaagtacctcaaccccttctctccttgtctctaacccttctctgcttttctgggagaggggcaagtacccctcaacccctcctctttcacccttagcagcaagtcccgcttttctacagggcaagaacccccaatctcttatttccgcaccccaacctcttatctctgcgccccaatcccttatttccgcaccccaacctcgtatctctgtgccccaatcccttatttccatgccccaaccccttatttccgtgccccgaccccttatttctgtgccccatcccttatttctgtgccccgacctcttatctctgtgccccaaccccttttcccacttttctggaaggtaagaacccccgaaccccttccctctgtttccctactctctcttttctctaggcttgcttccttgactataggcaaccttccaccctccattcctccttctactcccttggcctgtgttctcaaaaacttaaaacctcttcaactcacacctgacctaaaacctaaatgccttattttcttctgcaatgccgcttgaccccaatacaaactcgacagtagttccaaatagccagaaaatggcactttgaatttttccatcctgcaagatctaaataattcttgtcgtaaaataggcaaacggtctgaggtgcctgacgtccaggcattcttttacacatcagtcccttcctagtctctgtgcccaatgcaactcgtcccaaatcttccttctttccctcccgcctgtcccctcagtaccaaccccaagcatcgctgagtctttctaatcttccttttctacagacccatctgacctctcccttcctccccaggctgctcctcgccaggccgagctaggtcccaattcttcctcagcctctgctcctccaccctataatctttttatcgcctcccctcctcacacctggtcgggcttacagtttcgttccgtgactagccctcccccacctgcccagcaatttactcttaaaaaggtggctggagccaaaggcatagtcaaggttaatgctcctttttctttatcccaaatcagatagcgtttaggctctttttcatcaaatataaaaatccagcccagttcatgacgtgtttggcagcaaccctgagacactttacagccctagaccctaaaaggtcaaaaggccgtcttattctcaaaatacattttattacccaatctgctcctgacattaaataaaactccaaaaattaaattccggccctcaaaccccacaacaggatttaattaacctcgccttcaaggtgtacaataatagaaaaatgttgcaattccttgcctccactgtgagacaaaccccagccacatctccagcacaaaagaacttccaaatgcctgaaccgcagcggccaggcgttcctccagaacctcctcccacaggagcttgctacacatgcaggaaatctggccactgggccaaggaatgcctgcagcccgggattcctcctaagccgcgtcccatctgtgtgggaccccactgaaaatcggactgttcaactcacctggcagccactcccagagcccctggaactctggcccaaggctgactgactccttcccagatcttctcggcttagcggctgaagactgacactgcttgatcgcctcggaagccccctagacaatcacggacgccgagcttcgggtaactctcacagtggaaggtaagcccgtccccttcttaatcaatacggaggctacccactccacattaccttcttttcaagggcctgtttcccttgcctccataactgttgtgggtattgacggccaggcttctaaacctctgaaaactccccaactctgttgccaacttagaccatactcttttaagcactcctttttagttatccccacctgcccagttcccttattaggctgtgacactttaactaaattatctgcttccctgactattcctggactacagctatatctcattgccgcccttcttcccaatccaaagcctcctttgcatactcctcttgtatccccccaccttaacctacaagtataagatacctctactccctccttggcgaccaatcatgcaccccttaccatctcattaaaacctaatcacccttaccccactcaacgccgacatcccatcccgcagcacgctttaaaaagattaaagcctgttatcacttgcctgctacagcatggccttttaaagcctataaactctccttacaattcccccatttcacctgtcctaaaaccagataagccttacaagttagttcagaatctgcgccttatcaaccaaattgttttgcctatccaccccgtgctgccaaacccatatactctcctatcctcagtacctgcctctataacccattattctgttctagatctcaaacatgctttctttactattcctttgcacccttaatcccagcctctcttcgctttcacttggactgaccctgacacccatcaagctcagcaaattacctaggctgtactgccacaaagcttcacaggcagcccccattacttcaatcaagcccaaatttcttcctcatctgttacctatctcagcataattctcataaaaacacacgtgctctccctgccaatcgtgtccgactgatctctcaaaccacagcaacttctacaaaacaacaactcctttctttcctaggcatggttagtgtggtcagaattcttacacaagagccaggaccacaccctgtagcctttctgcccaaacaacttgaccttactgttttagtctagccctcatgtctgcgtgcagtggctgccactgcattaatacttttagaggccctcaaaatcacaaactatgctcaactcactctctacagttctcataacttccaaaacctattttcttcctcatacctgatgcatatactttctgcttcccagctccttcagctatactcactctttgttgagtctcccacaattaccgtcgttcttgacccagacttcaatccggcctcccacattattcctgataccacacctgacccccatgactgtatccctctgatccacctgacattcaccccatttccccaaatttccttctttcctgttcctcaccctgatcacgcttgatttattgatggcggttccaccaggcctaatccccacacaccagcaaaggcaggttatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagttcgaggatttgccccacccaggactggcaaattagctttactcaacatgccctgagtcagataactaaaatacctcttagtctaggtagatactttcactggataggtagaggcctttcctacagggtctgagaaggccaccgcaggcatttcttcccttctgtcagacataattcctcagtttagccttcccacctcaatacagtctgataacggacgagcctttattagtcaaatcagccaagcagtttttcaggctcttaatattcagtgaaacctttatatcccttacggtcctccgtcttcaagaaaagtagaatggactaaaggtcttttaaaaatacacctcaccaagctcagccaccaacttaaaaaggactggacaatacttttaccactttcccttctcagaattcaggcctgtcctcagaatgctacaggggtacagcccatttgagcggtatagatgctcctttttattaagccccagtctcattccagacaccagagcaacttaagactgtgccccccaaaaaacttgtcatccctactatcttctgtctagtcatactcctattcaccgttctcaactactcgtacatgccctgctcttgtttacactgccggtttacactgtttttccaagccatcacagctgatatctcctggtgctatccccaaactgccactcttaactcttgaagtaaataaataatctttgctggcaggactatgctgaatctccttaggcactctctaatcagatatcctgagttgtcccaattcttagaccttttatacctgtttttctccttctgttattccatttagtttctcaattcatccaaaaccgtatccaggccatcaccaatcattctatatgacaaatgtttcttctaacatccccacaatatcaccccttaccacaaggcctcccttcagcttaatctctcccagtctaggttcccacgccgcccctaatcctgcttgaagcagccctgagaaacatcgcccattctctctccataccaccccccaaaaattttcgccgccccaacacttcaacactattttgttttatttttcttattaatataagaagccaggaatgtcaggcctctgagctcaagccaagccatcgcatcccctgtgacttgcacttatacgcccagatggcctgaagtaactgaagaatcacaaaagaagtgaatatgccctgccccaccttaactgatgacattccaccacaaaagaagtgtaaatggccagtccttgccttaagtgatgactttaccttgtgaaagtccttttcctggctcatcctggctcagaaacacccccactgagcaccttgcgacccccgactcctgcccgccagagaacaaaccccctttgaatgtaattttcctttacctacccaaatcctataaaacggccccacccttatctcccttagctgactctcttttcggactcagcccgcctgcacccgggtgaaataaacagccatgttgctcacacaaagcctgtttggtggtctcttcacgcgcatgaaa

SEQ ID NO: 383 - DNA, 95 bp, Homo sapiens
gtcaggcctctgagcacaagctaagccatcatatcccctttgacctgcacatataaatccagatggcctgaagcaactaagaaaccacaaaagaa

SEQ ID NO: 384 - DNA, 929 bp, Homo sapiens
gtggggaaaagagagatcagattgttactgtgtctgtgtagaaagaagtagacataggagactccattttgttctgcaatctgtaaccttacccccaaccctgtgctccctgaaacaggtgctgtgtcaactcagggttaaatggattaagggctgtgcaagatgtgctttgttaaacaaatgcttgaaggcagcatgctcgttaagagtcatcaccactccctaatctcaagtacgcagggacacaaaacactgtggaaagccgcagcgacctctgcctaggaaagccaggtattgtccaaggtttctccccatgtgatagtctgaaatatggcctcgtgggaagggaaagacctgaccgtcccccagcccgacacctgtaaagggtctgtgctgaggaggattagtaaaagaggaaggaacgcctctttgcagttgagacaagaggaaggcatctgtctcctgctcgtccctgggcaatggaatgtctcggagtaaaacccgattgtatattccatctactgagataggggaaaaccgccttagggctggaggtgggacatgcgggcaacaatactgctctttaaggcattgaaatgtttatgtgtatacatatctaaagcaaagcacttaattctttaccttgtttatgatgcagagacctttgttcacgtgtttacctgttgaccctctctccactactatcctatgatcctgccacatcccactctccgagaaacacccaataatgatcaataaatactaatggaactcagaggctggcagagatcctccgtgtgctgagcgccggtcccctgggcccccttttttctttctctatactttgtctatgtccctttcttttccaagtctctcgttccacctaacgagaaacacccacagatgtggaggggcaacccaccccttca

SEQ ID NO: 385 - DNA, 928 bp, Homo sapiens
gtggggaaaaggaggacagatcagactgttactgtgtctatgtagaaagaaatagacataagagactccattttgttctgtactaagaaaaattcttctgccttgagatgctgttaacctgtaaccctagccccaaccctgtgctcccagaaacatgtgctgtgtcacacgtgggtttagggctatgcaggatgtgctttgttaaacagatgcttgaaggcagcatgcttgttaaaagtcatcaccactctctaatctcaagcacccagggacacaatacactgcggaaggctgcagggacctctgcctagaaaagccaggtattgtccaaagtttctccccatgtgatagcctgagataaggcctcgtgggaagggaaagaccagaccgtaccccagcccgacacccgtaaagggtctgtgctgaagaggattagtataagaggaaggcctttttgcagttaagaggaaggtatctgtctcctgctcgtccctgggcaatggaatgtctcggtgtaaaacccgatggtatgttccatccaccgagataggggaaaaccgccttagggctggaggtgacacatgctggcagcaatactgctctttaatgcaccagatatgtttatgtatgagcacatcaaggcacagcacatttcctaaccttgtttatgacacagacatttgctcacatgttttcctgctgaccctctccccactgttaccctattgtcctgccacatccccgtctccgagatggtagagataatgaccaataaatactgaaggaactcagagacccggccggcgcgggtctcctgagcccacttttctttctgtgtactttgtctctgtgtctctttcttttctcagtctctcgtcccacctgacaagaaacacccacaggtgtggaggggcaggccaccccttca

SEQ ID NO: 386 - DNA, 618 bp, Homo sapiens
gcctgagatatggcctcatgtgaagggaaagaccttactgtcccccagcccaacacccgtaaagggtctgtgctgaggaggattagtaaaagaggaaggcctctttgcggttgagataagaggaaggcctctgtttcctgcatgtccctgggaatggaatgtctcagtgtaaagccgaacattcattctattctgaaataggagaaaaccgccctgtggctggaggtgagatatgccagcggtgatactgctctgttactctttgctacactgagatatttggataaagagaaacataaatctagcccatgtgcacatccgagcacagtagctttccttgaacttatttatgacgcagattcctttgctcacatgtttttctgctgaccttctccccgccatcaccctgttctcctgccgcactccccttgttgagatagtgaaaagagtaatcaataaatactgagggaactcagagaccagctctggtgcaggtcctcgcatgctgagtgtgccggtcccctgggcccactgttctttctctgtactttgtctctgtgtcttatttttctgtctctcatctccacctgatgagaaatacccacaggtgtggagggg

SEQ ID NO: 387 - DNA, 51 bp, Homo sapiens
agctacacccactatgcccactgtcagcaggaagaagttagggcagtcgtc

SEQ ID NO: 388 - DNA, 1732 bp, Homo sapiens
aaaaaaaagattaatcctagttgtcctggaggacttggagccactgtctgttggacttacttcacccatactgatatgtctgataggggtggagttcaagatcaggctagagaaaaacacgtaaaggaagtaatctcccaactgacctgggtacatagcacccctagcccctacaaaggactagatctctcaaaactacatgaaaccctctgtacccatactcgcctggtaagcctatttaataccgccctcactgggctccatgaggtctcagcccaaaaccctactaactgttggatgtgcctccccctgcacttcaggtcatacatttcaatccctgtacctgaacaatggaacaacttcagcacagaaataaacaccacttccgttttggtaggacctcttgtttccaatctggaaataacccatacctcaaacctcacctatgtaaaatttagcaatactatagacacaaccaactcccaatgcatcaggtgaataactcctcccacaggaatagtctgcctacccccaggaatatttttgtctgtggcacctcagcctatcgttgtttgaatggctcttcagaatctatgtgcttcctctcattcttagtgccccctatgaccatctacactgaacaagatttatacaattatgttgtacctaagccctgcaacaaaagagtacccattcttccttttgttatcagagcaggagtgctaggtggactaggtgctggcattggcagtatcacaacctctactcagttctactacaaactatcccaagaactaaatggtgacatggaatgggttgccgactccctggtcaccttgcaagatcaacttaactccctagcagcagtagtccttcaaaatcaaagagctttagacttgctaaccgccaaaaggggggggaacctgtttatttttaggggaagaatgctattattatgttaatcaatccggaatcatcaccgagaaaggtaaagaaatttgagatagaatacaacatagagcagaggagcttcaaaacactggaccttggggcctcctcagtcaatggatgccctggattctccccttcttaggacctctagcagcaataatattgttactcctctttggagcctgtatctttaacctccttgttaagtttgtctcttccagaattgaagctgtaaaactacaaatcattcttcaaatggagccccagatgctgtccgtgactaagatctaccacagacccctggaccagcctgctagcccatgctccgatgttaatgacatcaaaggcacccctcccaaggaaatctcaactgcacaacccctactatgccccagttcagcaggaagcagttagagccatcatcggccaacctccccaacagcacttgggttttcctgttgagatgggggactgacagacaggactagctggatttcctaggccgactaagaatccctaagcctagctgggaaggtgaccacttccacctttaaacacagggcttgcaacttagctcacacctggccaatcagatagtagagagagctcactaaaatgctaattagacaaaaaacaggaggtaaagaaatagccaatcatctattgcctgagagcacagcgggatataaacccaggcattcgagccggcaatggctaccctctttgggtcccctccctttgtatgggagctctgtcttcactattaaaccttgcaactgca

SEQ ID NO: 389 - DNA, 965 bp, Homo sapiens
gtggggaaaagaatgagagatcagattgttactgtgtctgtgtagaaaaggaagacataagaaactccactttgatctgtactaagaaaaactgttctgttttgagatgctgataatccataactttagcctcaaccctgtgctcacagaaacacgtggtttaatggatttagggctgtgcagcatgtgccttgttaaccatatgtttgcaggcagtatacttggtaaaagtcatggccatcctccagtctcgattaaccagggacacaatgcactgcggaaagccgcagggacctctgcccgagaaagcctgggtattgtccaaggtttcccccactgagacagcctgagatatggcctcatgggaaaggaaagactttaccatcccccaacccgacacccgtaaagggtctgtgctgaggaggaggagtgaaagagggaggcctctttgcagttgagataagaggaaggcttctgtctcctgctggtccctgggaatggaatgtctaggtgtaaagctgaccattcccattcattccattctgagataggagaaaattgccctgtggctggaggcgagatatgctggcagcaatactgctctgtgactctttgctacactgagatgtttggatgaagagaaacataaatctagcctacgtgcacatacgggcacagtacctttccttgaacttattcatgatacagattccttcgctcacatgtttctctgctgaccctctccccacctgttgcccagccacattcccctcgccaagatagtaaaaatagtgatcaataaatactgagggaactcagagaccagcgccagtgcgggtcctcgcacgttaagcgtctgtcccctgggcccactgttctttctctatactttgtctctgtgtcttgtttcttttctgagtctctcatctccacctgactagaaatacccacaggtgtggaggggc

SEQ ID NO: 390 - DNA, 3611 bp, Homo sapiens
tggaaactcttattattaactgagccaggccaagggataggaatagctctggctaagcggtggccaaggatgtgggcagaagacaaccctccagggttggcaatcaaccaggcccccatactcatagaatttaagcctggggcccagccagtcaggcaaaatcagtacccggtccccagagaagttcttgaaggtatccaggtccatctcaagtgcctgagggcctttggaattatagttccttgtcagtctccatggaacactcccctcctgcctgttcccaagtcagggaccaaggactacaggccagtgcaggacttgtgcttggtcagtcaagctacagtgactttgcacccaatggtacctaacccatacacattgttggggttactgccagctgaggacagctggttcacctgcctggacctgaaggacactttctttagcatgagactagaccctgagcgccagaaactgtttgcctttcagtgggaggatctgtggtcaggtgtcaccactcagtacacttgaacccagcttccccaagggttcaagaactcccccaccatcttcagggaggcattggctcgagacttccaaaagttccccgctagagacctaggttgcgtgttgctccagtacattgatgacctcctgctgggacaccccacagcagtcgggcgcaccaagggaatggataccgtgctccagcacctggaggactgtgggtataaggtgtccaagaagaaagctcagatctgccaacagcaggtatgttacttgggatttactatccgacagggagagtgcagcctgggatcaaaaagaaagcaggtcatttgcaacctaccggagcctgagaccagaaagcagttgagagaattcttaggagctgtggggttctgcaggttatggatcccaaactttgcagtactggccaagcctctgtatgaagtcacaaagggggataacaaagagtcttttgaatgggagtcccaacagcaacgagcttttcatgagttaaaagagaaactcatttcagccccagccctggggctgcctgacctgacaaagccatttacactatatgtgtcagagagagaaaaaatggcagttggaattttaacccagacggtggggccctggccaagactggtagcctacctctccaaacaactagatggagtttttaaagattggcccccgtgtttgagggccttggcagcaactgccctgctagcacaagaagtggataaactaactcttgggcaaaacctgaacataaaggcctcccatgctgtggtgactttaatgaataccaaagggcatcattggctcatgaatgctagactaactaggtaccaaaacttactctgtgaaaagccctgcataactattgaagtttgcaacaccttgaaccccgccaccttactcccggtaccagagagcccagttgaacagaactgtgtagaggtattggacacagtttattctagcaggctggacctccaagaccatacttgggcatcagtagactgggagctgtatgtggacaggagcagctttgtcaacccacaaggagagaggtgtgcgtgatatgcagtggtaaccctggacgctgtcattgaagccaaatcattgccccagggtacttcagcccagaaggccgaactcattgctttaatttgggccttagagctaagtgaaggtaagactgtaaatatttatactggctctcggtatgccttcttaaccctccaagtgcatggggctttatataaaggaaaagtcctgttgaactctgggggaaaagacatatatcagcaagagatcctgcagttattgaggcagtatggaagctccaaaaggtggcagtcatgcactgcaaagaacaccagtgaacttccaccttgattgcattgggcaactcctgagctgactcagaggctcgaaaatcagcatccaccccctaccgggcatcagtcacagtccccctgctccctcaggtacctgaccttgtacttacttaatctaaagaagagaaggaccttctccaggcagagggagggcaggtgatagaagagggatggatccagttgttggatggaagaatagccatgccataactgcgaggagccgcagtcgtactggctgtgcaggagaccacccacctaggtcaagatcacttgaaaagttgttgggccagtacttctacatctcgcatctgtcagcccttgccagaaatagtggtgcagcagtgtgttgcctgccggcagcgcagtgctgagcaaggtccaaccatcccacccggcatacgagcttctggagcagctccctttgaagatttccaagtagactttactgagatgcccaaatgtggaggtaacaagaaattgctagttctagtgtgtacatactctgggtgggtagaggcctatccaacacggactgagaaagctcgtgaagtaacccgtgtgcttctctgagatctcatccctaagtttgggctgcccttacgaatcagcttggacaacgggctggcatttgtggctgactcggtacagaagacagcaaaggtgattgggtgtggatcaaggattggaacatagccccgttgcggccacagtggaaaggaccccagaccgttgtcttgaccacccccacagccataaaagtagaggaaatcccagcctggatccaccacagtcacataaagcccgcagcacctgagacctgggaggggaaaccaagcccagacaacccatgcaaggtgactttgaagaagatgacaagccctgccccaatcacacccggaagctgacgggtccacgcatggccaaagcatgaggaaactcatcgtgggactcattttccttaaatttcggacttgtgcagtaaggacttcaactgaccttcctcagactgaggactgttcaagttactgagtagggcaaaaagttaaaacagtctttctgttttatagttattatgaatgtactggactctaaaagggacttgtgtgtataatgccacccagtacaaggaatgcatcccaggaagtgaccaacctgatgtgtgctataacccgttagaactacttgatctccgttggaaaacaggagagtatgtaactctaggaatcgatggaactggactggcaggaagacctgggttgtgaacatgacagtgagaactctcactagtgaatgaggttctcaaagggggaaatgaggagcgaggccatttctcttactgtctcctgtctctgaagagaaggaggaagtaaaaagttgaaaaacaacaggaatgaagtcagtggcaaggccagccagtgccactgatgaccaggcctgaggttaaaaggttaaccccccactctaaccacatctgctcttaatctatcacaaccgtttcatgtggaaccccttagagttgtaagcccttaaaagggccaggaactctggctttggcgagctcggttcttgagacatgagtctgccgaagctcccggctgttgagacgtgagtctgccgaggctcccggccaaataaagccaaatccttccttcacccagtgtctgaggggttttgtcagtggttcgtcctgctaca

SEQ ID NO: 391 - DNA, 8823 bp, Homo sapiens
atggtatgagaccaccacttctcctgttgtcttttttagtttctccccaacctccccttttccctagtttataagacaggagaaaagggagaaagcaaaaagttggaaagaaacagaagtaagataaatagctagacgaccttggtgccaccacctggccctggtggttgaaataataataatattaacccctgaccaaaactactggtgctatctgtaaattccagacattgtatgagaaagcactgtaaaactttttgttctgttagctgatgtatgtagcccccagtcacgttcctcatgcttgcttgatccattatgactctttcacgtagaccccttagagttgtaagcccttaaaagggccaggaatttcttttttggggagctgggctcttaagacacgagtctgccgatgctcccagctgaataaagaaacctcttccttctttaattcggtgtctgaggagttttgtctgcgactcgtcctgctacatttcttggttccctgactgggaagcgaggtaattgatagacagtcgaggcagccccttaggcggcttaggcctgccctgtggagcatccctgcaggggactctagccagcttgagcgacgcggatcctgagagcgctcccaggtaggcaattgcctcggtggaatgcctcgtcagagcagtgtgtggcaggcccccgtggaggatcaacgcagtggctgaacaccgggaaggaactggcacttggagtctggacatttgaaacttggtaagactggtctttggaacttgcccactccatttgagtggaagcgtggcctgagcacccatggtgtgcctgtactggcactttggtttttgtttttgacttgacttaaattgcttgatactttggttttggtttgacctggcttggatttctggatactctgattttggttttgattctggtttggtgaaaactgaaaaagtgtgtgtgtgccctttttacctattctttgttctgtggtgtgcgtgtggtgtgagctcggtgttttgtcttaaggaaacatgggtcagacacaaagtaagcttactccgctaggaactatgttgaaaaattttaagaagggatttaatggagactatggggttactatgacaccaggaaaacttagaactttgtgtgaaatagattggccaacattagaagtggattggccatcagaaggaagcctggacaggtcccttgtttctaaggtatggcacaaggtaactggtaagtcaggacactcagaccagtttccatacatagacacttggttacatctggtagaccccccgcagtggctaagagggcaggcagcagcagtgctagtagcaaagggacagatagccaaggaaggatcccgctccacccgccgagggaaatcaactcctgaagttctgttcgacccaacatcagaagatccattgcaggagatggcaccagtgatcccagtggtgccctcccgttaccagggagagaggctcaccacttttgagtccacggggcttgcacctccacaagacaaacatccctaggccacccagagtaggcaagagaggaggtgaagcctcgggagaaacccctcccttggcagctggtttaagacccaaaacggggatacaaatgcccctgagagagcagtggtatactggaatagatgaggatgggcacatggtggagaggcgtgtttttgtgtaccagcccttcttctctgccgacctcctcaactggaaaaacaataccccatcctatactgaaaagccgcaagctctaattgatttgctccaaactattatccagacccataaccccacttgggctgattgccaccagttgctcatgttcctctttaacacagatgaaaggcggagagtgctccaagcagcaactaagtggctagaggaacatgcaccggctgattaccaaaacccccaagagtatgtaaggacccagttaccgggaaccgacccccagtgggacccaaatgaaagagaggatatgcaaaggctaaaccgatacagggaagctctcttggaaggattaaagaggggagcccagaaggccacaaacgtggccattcagggaaaagaagaaagtccagcacaattctacgagaggctgtgtgaggcctattgtatgtatactccctttgatcccaatagtcctgaaaatcagcgcatgattaacatggctttagttagtcaaagtgcagaagacattagaagaaaactgcagaaacaggctgggtttgcagggatgaacacatcacagttattagaaatagctaaccaggtgtttgtaaacagggatgcagtaagccctaaggaaaaccgcagagagaatgaacatcaggtccggcgaaatgccgacctgttagctgcagcaatcacaggggtccccccaaagaggcaagggaaggggggccccgggaaagaaattcagcctggttgtcagagcttgcagcgtaatcagtgtgcttattgtaaagaaataggacattggaagaacaaatgccctcagctaaaaggaaaacaaggtgactcggagcaggaggatccagacaaggaggaaggggccctgctcaacctggcagaaaggttattggactgagggggaccgggctcaaggacccccaaagagcctatggtcaggatgacagttgggggtaaagacattgattttcttgtagataccggtgctgaacattcggtagtaaccaccccggtcagccccttatccaaaaagactattgacataattggagccacaggagtttcagcaaaacaagctttctgcttgccccggacttgtactgtaggaggacataaagtgattcatcagtttttgtacatgcctgattgtcccttgcccttgttgggaagggacttgcttagcaaactgagagccactatctattttacagagcatggctctttgctgctaaagttacccggaacgggagtcattatgacccttatggtaccccgagaggaggaatggaaacttttcttaactgagtcgggccaagagataagaccagctctggctaagtggtggccaagagtgtgggcagaagacaaccctccagggttggcagtcaaccaagcccccgtacttatagaagttaagcctagggcccagccggttaggcaaaaacagtacccggtccccagagaagctcttcaaggtatccaggtccatctcaagtgcctaagaacctttggaattatagttccttgtcagtctccatggaacactcccctcctgcctgttcccaagcctgggaccaaggactacaggccggtacaggatttgcgcttggttaatcaggctacagtgactttacacccaacagtacctaactggtacacattgctggggttgctgccagctgaggacagctggttcacctgcttggacctgaaagatgctttctttagcatcagattagcccctgagagccagaagctgtttgcctttcagtgggaagatccggagtcaggtgtcactactcagtacacttggatccggcttcccaaagggttcaagaactcccccaccatcttcggggaggcattggctcaagacctccagaagtttcccaccagagacctaggctgcatgttgctccagtacgttgatgacctttttctgggacaccctacggcagtcaggtgcgccaagggaacagatgctctactccggcacctggaggactgtgggtataaggtgttcaagaaaaaagttcagatctgccgacagcaggtacgttacttgggatttactatccggcagggggagtgcagcctgggatcaaaaagaaagcaagtcatttgtaatctaccggagcctaagaccagaaggcaggtgagagaattcttaggggcagtggggttttgcagactgtgggtcccaaactttgcagtattagctaagcctttgtatgaggtcacaaaggtgggggactgggaacattttgaatggggatcccagtaacagcaagcctttcatgagttaaaggaaagacttatgtcagccccagccctggggctacccgatctgacaaagccttttatattatatgtgtcagagaaagaaaagatggcagttggagttttaacccatactgtggggccctggccgaggccagtggcctacctctctaaacaactagatggggtttctaaaggatgacccccatgtttgagggccttggcagcaactgccctgctagtacaagaagcagataagctgactcttgggcaaaacctgaacataaaggccccccatactgtggtgactttaatgaatactaaaggacatcattggctaatgaatgctagactcactaagtaccaaagtttgctctgtgaaaatccccatataaccattgaagtttgtaacaccctgaaccccgctaccttgctcctggtatcagagagccctgtcaagcatgactgtgtagaagtgttggactcagtttactctagcagacctgacctccgggaccagccttgggcatcagtagactgggtactatacgtggatgggagcagcttcatcaacccacaaggagagagatgtgcagggtatgcggtggtaactctggacactgttgttgaagcccgatcgttgccccagggcacttcagctcagaaaactgaactcattgctttaatttgggccttagaactcagtgaaggtaagactgtaaacatttacactgactgtcgatatgcctttttaacccttcaagtgcatggagcattatataaagaaaagggtctattgaactctgggggaaaggacataaaatatcaacaagaaatcttgcaattattagaagcagtatagaaaccacacaaggtggcagttatgcattgcagaggacaccagtgggcttccaccttggtgggtttggggaattcccacgctgacttagaggctcgaaaagcagcatctgcccccttccgggcatcagtcacagcccccctgctccctcaagcacctgatcttgtacctacttattctaaagaagaaaatgactttctccaggcagagggaggacaagtgatggaggaaggattgattcggttaccagatgggagagtagctgtgccacagctgctaggagctgcagttgtactggctgtccatgaaaccacccatctaggtcaggaatcacttgaaaagttgttaggctggtatttctacatctcgcatttgtcagcccttgccaaaacggtgacccagcggtgtgttacctgccgacagcataatgcgaggcaaggtctagctgttccacctggcatacaagcttatggagaagccccctttgaagatctggatccaggtggacttcacagagatgccaaagtgtggaggtaacaagtatttactagttcttgtgtgtacctactctgggtgggtggaggcttatccaacacgaactgagaaagctcgtgaagtaactcgtgtgcttctttgagatcttattcctagatttggactgcctttatggatcggctcagataacgggccggcatttgtggctgacttggtacagaagatggcaaaggtattggggatcacatggaaactgcatgctgcctaccggcctcagagttccggaaaggtggagcagatgaatcggactatcaaaaatagtttagggaaagtatgtcaggaaacaggattaaaatggatacaggctctccctatggtattatttaaaattagatataccccttctaaaagaacaggatattccccttatgaaatattatatcataggccccctcctatattgcggggacttccaggcactccctgagagttaggtgaaattgagttacagtgacagctacaggctttaggaaaaattacacaaacaatctcagcctgggtaaatgagaaatgccctgttagcttattctccccagttcaccctttctccccaggtgatcgagtgtggatcaaggactggaacgtagcctttttgtgtccacggtggaaaggaccccagactgtcgtcctgaccactcccaccactgtgaaggtagagggaatcccagcctggatccaccacagccatggaaaacctacagcacctgaaacctgggaggcaagaccaagcccagacaacccttgcagagtgaccctgaagaagacgacaagccctgctccagtcacacctggaagctgactggtccacacatggctgaagcatgaggaagctcatcatgggattcatttttcttaaattttggacttatacagtaagggcttcaactgaccttactcaaactggggactgttcccagtgtattcatcaggtcaccgaggtaggacagcaaactaaaacaatctttctgttctatagttattatgaatgtatgggaacattaaaagaaacttgtttgtataatgccactcagtacaaggtatgtagcctgggaaatgactgacctgatgtgtgttataacccatctgagccccttgcaaccatcgtttttaaaataagattaagaaatggccttttcctaggtgatacaaggaaaataataactagaacagaagaaaaaaggaatccccaaacaaataactttaagatgtgatgcttgtgcagccattaatagtaaaaagctaggaataggatgtggttctcttaactgggaaaggagctacagagtagaaaataaatatgtttgtcatgagtcaggggtttatgaaaattgtgcctgttggccatgtgttatttgagctacttggaaaaagaacaaaaaggacccagtttatcttcagaagggggaagccaacccctcctgtgctgccggtcactgtaacccactagaactaataattaccaatcccctagatccccgttggaaaaacggagaacgtgtaaccctggggattgatgggacagggttaaacccccaagttgccattttaattagaggggaggtccccaagcgctctcccaaaccagtatttcaaaccttttatgaggagctgaatctgccagcaccagaacttccaaaaaagacaaaaaatttgtttctccaattagcagaaaatgtagctcattcccttaatgttacttcttgttatgtatgcgggggaaccactatcggagaccgatggccttgggaagcccgagagttggtgcctactgatccagctcctgacataattccagttcagaaggcccaagctagcaacttctgggtcttaaaaacctcaattattggacaatactgtatagctagagaagggaaagactttatcatccctgtaggaaagcttaattgtataggtcagaagttgtataacagcacaacaaagacaattacttgttggggcctaaaccacactgaaaagaagccatttagtaaattttctaagttaaaaactgcttgggctcatccagaatctcatcaggactggatggctcccgctggactatactggatatgtgggcacagagcctatattcggttacctgataaatgggcaggcagttgtgttattggcactattaagctgtgctttttcttattacccataaaaacgggtgagctcctaggtttccccatctatgcctcccaagaaaagagaggcatagttataggaaactggaaagataatgagtggccccctgaaaggatcatacagtattatgggcctgccacatgggcacaagacggctcatggggataccgaacccccatctacatgctcaatcggatcatacggttgcaggccatcttaaaaataattactaatgaaactggcagagctttgactgttttggcttggcaagaaacccaaatgaggaatgctatctatcagaatagactggccttggactacttgctagcagctgaaggaggagtttgtggaaactttaacttaaccaattgctgcctacaaatagatgatcaaggacaggtggttgaaaacatagtcagggacatgacaaaggtggcacatgtgcctgtacagattaaactgtacacgagtttaatcctgagtctttatttggaaaatggtttccagctatgggaggatttaaaaccctcattgtaggtgtattgctagtaataggaacttgcttgctgctcccctgtgtattacccttgctttttcaaataataaaaggttttgttgctattttggttcatcagaaaacttcagcacaggtgtattatatgaatcactatcgctctatctcgcaaagagactcaaaaagtgaggatgagagtgagaactcccactaaaaagtgaaaattctcaaaggggggaaatgtggtatgagaccaccacttctcctgttgtccttcccagtttctcccctacctccccttttccctaatttataagacaggagaaaagggagaaagcaaaaagttggaaagaaacagaagataaatagctagatgaccttggcgccaccacctggccctggtggttaaaataataataatattaacccctgaccaaaactactggtgttatctgtaaattccagacattgtatgagaaagcactgtaaaactttttattctgttagctaatgtatgtagcccccagtcatgttcctcacgcttacttaatctattataactctttcacgtaaaccccttagagttataagcccttaaaagggctaggaatttctttttcggggagctcggctcttaagacatgagtctgctgacgctcccagctgaataaaaaaacctcttccttctttaattcagtgtctgaggagttttgtctgcgactcgtcctgctaca

SEQ ID NO: 392 - DNA, 972 bp, Homo sapiens
agaacactcaaagctcaattggttaaacaaaaaaaggaaaaacacagtaaggagtataacactccccagatgcaacttaatctaacactctatactttaaattttctaaacatacagagaaatcagaccactacttctgcagaacattttcctggtaaaaagaacagcccacatgagggaaaactgatttggtggaagacaacaaaaacaaaacatgggaaataggtaaggtgataacatgggggagaggttttgcttgtgtttcaccaggagaaaatcagcttcctgtttggatacccactagacatttgaagttctacaatcaacccatcagagatgcaaatgaaagtgcctccgcagagacagaaaacccgcaatcaagcatcatcgactcgcagggtgaacaaaatggtgatatcagaagaacagatgaagttaccatccaccaagaaaacggcacatgtggagagccagggagaagaatagaaagaaaaagagacagagatcagagacagacacagaaagtgagattggggagagagatagtgtaaaagagagagagagagagagaccataagagaagggagacaaagagataaaaggtgcgagtcatcaggtgaggagaaagactgaaaacgatgagaaacagcaactaagacacaaaggaggtgggagactgcctgggtgccgcagcacccacaccgtcctcttgcccccgtcacttgggttaaaaccaccggaaattccactattgcaaattttgtattaatccttgtatgtctgtcttttctgttgttagtctacaggtgtatccagcagctccagagagacagcgaccgaccagagagaaggggccatgatgatggtggtggttttgtcaaaacgaaaagggggatatgtagggaaaagaaagagagatcagactgttactgtgtctacatagaaagggaagacataagagactccattttg

SEQ ID NO: 393 - DNA, 2713 bp, Homo sapiens
ccacattattcctgataccacacctgacccccatggctgtatctttctaatccacctggcatttgcaatttccccatatttccttcttttctgttcctcaccctgatcacacttggtttattcatggcagttccaccaggcctaatcgccactcaccagcaaaggcaggctatgctatagtatcttccacatctatcgttaacactactgctctgcccccctccactacctctcagcaagccgaactcattgccttaactcaggccctcactcttgcaacgggactacgcatcaatatttatagtgactctaaatatgccttccataccctgcaccaccatgctgttatatgggcaggaagaggtttgctcactacacaagggtcttccatcattaatgcctctttaataaaaactcacctcaaggctgctttacttccaaaggaagctggagtcattcactgcaagggccatcaaaaggtatcagatcccatcactcagggcaatgcttatgctaataaggtagctaaagaagcagttagcattccaactttggtcccttatggccaatttttctccttctcatcagtcagtcccacctactcccccactgaaacatcaccctatcaatctcttcccacacaaggcaaatggttcttagacaaagggaaatatctctttccagcctcacaggcccattctattctgtcatcatttcataacctcttccatgtaggtcacaagcctctagcccatctcttagaacctctcatttcctttccatcatggaaatctatccttaaggaaaacacttctcagggttccatctgctattctactactcctcagggagtgttcaggccccctccctttcctacacatcaagctcagggatttgcccctgcccaggactggcaaattgactttactcacatgccccaagtcaggaaactaaaataccacttggtctgggaagacactttcactggatgggtagaggctttcccacagggtctgagaagcccatcgtggtcatttcttcctttcaatcagacataattcctcggtttggccttcccacctctatatagtccaataatggaccggcctttattagtcaaatcacccaagcagtttctcaggctcttggtattcagtggaaacttcataccccttaccatcctcaatcttcaggaaaggtaaaatggactaatggtcttttaaaaacatacctcaccaagctcagcctccaatttaaagactggacaatacttttaccacttgcccttctcagaattcaggcctgtcctcgggatgctacagggtacagcccatttgagctcctgtatggatgctcctttttattaggccccagtctcattccagacaccagcccaacttgaactgcaccccaaaacttgtcacccctactatcttctgtctagtcatactcctattcgccattctcaactactagtaaataccctacccttgtttacacttttccttcaaaccatcataactgatatctcctggttttacctcaaaacccttaagtctctcttaaagtggatagatgatctttgctgacagagtacactccaatactttcaccttcatgaagtcttattctttacttttatactcactcttattctcgttcctattcttatgccaccctctacctctccccagctatctccaccacactatcaatctcagtcactctctgctagccatttctaatccttctttaacaaacaattgctggctttgcatttctctttcctccaaaatcacggaggcctcgacttactcactgctaaaaaaaaaaaggcactctgtatatttttaaatgaagagtgttgtttttacctaaatcagtctggcctggtatatgacaacataaaaaaactcaatgatagagcccaaaaacttgccaaccaagcaggtaattacactgaacccccttgggcactctctaattggatgtcctgggtcctcccaattcttagtcctttaatacctgtttttctccttctcttattcagaatttgtgtcttccgtttagtttttcaattcatacaaaaccacatccacgccatcaccagtcattctatatgacaaatgttctttctaacaaccccacaacattgccccttaccacaaagtcttccttcagcttaatctgtcccactgtaggttcccaggctgcccctaatcccgcttgaagcagtcctgagaaacatctccctttatctctccatacctccccccaaaaatttttgctgcctcaatacttcaatactattttatgttatttttcttattattataagaagacaggaatgtcaggcttctgagcccaagcctgcacatatacatccagatggcctgaagtaactgaagaatcacaaaagaagtgaaaatggccggttcctgccttaactgatggcattaccttgtgaaattccttctcctggctcagaagctcccccactgacgaccttgtgacccctgcccctgcctgccagagaacaatcccctttgactgtaattttccactacccactcaaatcccataaaacagccccacccctatctcccttcgctgactctctgtttggactcagcccacctgcacccaggtgattaaaaagctttattgttcacacaaagtctgtttggtggtctcttcaaacagacatgcatga

SEQ ID NO: 394 - DNA, 364 bp, Homo sapiens
actgaagaatcacaaaagaagtgaaaatagtcagtccctgccttaactgatgacactccaccattgtgatttgttcctgccccaccctaactgatcaattaaccttgtgacattccttctcctagacaatgagtctcagaacctcctcactgaacaccttgtaacccctgcctctgcctgcaagaaaataaccccctttaactataattttccactacctacccaaatcctataaaactgccccacgcctatctccctttgctgactccttttttggactcagtccgccttcacccaggtgattaaaaagctttattgctcacacagagcctgtttggtggtctcttcgcatggatgcacatga

SEQ ID NO: 395 - DNA, 917 bp, Homo sapiens
agcagacatgagactctattttgttctgtactaagaaaaattcttctgccttgagatgctgttaatctgtaaccctacccccaaccctgtgctccctgagacatgtgctgtgtcaactcagggttaaatggattaagggctgtacggggtgtgctttgttaaacaaatgcttgaaggcagcatgcttgttaagagtcatcaccactccctaatctcaagtacccagagacacaaaacgctgcggaaggccacagggacctctgcctgggaaagccaggtattgtccaaggtttctccccatgtgatagcctgatatatggcctcctgggaagggaaagacctgactgtcccccagccggacacccataaagggtctgtgctggggaggattattgaaagaggaaggcctctttgcagttgagataaaaggaaggcatctgtctcctgcttgtccctgggcaatgggacatcttggtatcaagcccgattgtatattccatctactgagataaaggaaaaccaccttagggctggaggtgggacatgctggcagcaatactgctatttaatggattaagatgtttatgtgtatgcacatcagaagcacagcagttaattctttaacttgtttaagatgcagagacctttgttcacgtgttttcctactgaccttctctctgctattaccctattgtcctgccaaatccccctccccgggaaacgcctgataatgatcaataaatactaagggaactcagaggctggtaccggcatgggtcctccgtatgctgaacgcccttcccctgggccctattttctttctctatactttgtctctgtgtctctttcttttccaggtctctcattccatgtaaggagaaacacccacaggtgtggaggggcaacccaccccttca

SEQ ID NO: 396 - DNA, 6690 bp, Homo sapiens
gtcaggcctctgagcccaagccaagccatcacatcccctgtgacttggacatacacgcccacatggcctgaagtaactgaagaatcacaaaagagtgtgaatatgccctgccccaccttaactgatgacattctaccacaaaagaagtgtaaatggccggtccttgccttaagtgatgacattaccttgtgaaagtccttttcctggctcatcctggctcaaaatcacccccactgagcaccttgtgaccacactctgcccgccagagaacaacccacctttgactataattttcctttacctacccaaatcctataaaatggccccacccctatctcccttcgctgactctcttttcagactcagcccacctgcgcccaggtgattaaaagctttattgctcgcacaaagcctgtttggtggtctcttcacacagatgcgcatgaaactcacattcctgtaatttttttttttttttggctccctctctttgctttatcttcccatgtgcaggatatcctcctgccctttccaaactcatcccaatctccaaagcccttttctgatatcagttccttcatcaaaatgccaccatctgtagcacaccctgccactgcctcctgtttctcttctgcactgaccctccttgctcctcatataaggtaaatcggaagcatattccacatcatttcctggagcttcccaatgagattgagctcccattgtccccagtgataatttacttaaaaactcatgctttatcaatatcccctcatgcttcagtgtttcctgggagtgctttcccaataaaccacttgctcttggatcctcatctcagaatttgcttctaggaaaattaactaagatagtatctgtcaggcctctgagcccaagccaagccatcacatcccctgtgacttgcacgcatatataagcccagatggcctgaagtaactgaagaatcacaaaagaagtgaatatgccctgccctaccttaactgatgacattccaccacaaaagaagtgtaaatgcctggttcttgccttaagtgatgacattaccttgtgaaagtccttttcctggcacatcctggctcaaaaagcacccccaatgagcaccttgcgacccccactcctgcccgccagagaacaaaccccatttgactgtaattttcctttacctacccaaatcctataaaacggccccacccttatctcccttcgctgactctctttttggactcagcccacctgcacccaggtgaaataaacagccatgttgctcacacaaagcctgtttggtggtctcttcacacggacgcacatgaaatttggtgccatgactctgatcgggggacctcccttgggagatcaatcccctgtcctcctgttcttcgctctgtgagaaagatccacctacgacctcaggtcctcagaccgaccagcccaaggaatatctcaccaattttaaatctggtaagcggcctctttttactctcttctccaacctccctcactatccctcaacctctttctcctttcaatcttggcgccacacttcaatctctcccttaatttcaattcctttcattttcggggagagacaaaggagacacgttttatccgtggacccaaaactccagcgccggtcacggactgggaaggcagccttcccttggtgtttaatcatggcagggatgcctgattattcatccatgtttcaaaggtgtcagaccacacagggacgcctgccttggtccttcgcccttagcggcaagtcccgcttttctggggaaggggcaagtaccccaaccccttctctgcttttctgggcaaggggcaagtaccataacgccttctctccttgtctctaccccttctctgctttcctggggcaagggcaagtttccctcaaccccttctccttcacccttagtggcaagtcccgcttttctgggggggcaagaatccccaatcccttatttccgcaccccaacctcgcatctctgcccctcgatcccttatttcggtgccccgaccccttacttctgtgccccatcccttatttctgccccccgacctcttatctctgcaccccaaccccttttcccacttttttggaaggtaagaacccccgaaccccttccctccgtttctatactctctcttttctctaggcttgcttccttcactataggcaaccttccaccctccattcctccttctactcccttggcctgtgttctcaaaaacttaaaacctcttcaactcacacctgacctaaaacctaaatgccttattttcttctgcaatgctgcttgaccccaatacaaactcgacagtagttccaaatagccagaaaatggcactttgaatttttccatcctgcaagatctaaataattcttgtcgtaaaataggcaaacagtctgaggtgcctgacgtccaggcattcttttacacatgagtcccttcctagtctctgtgtccagtgcaactcatcccaaatcttccttctttccctcccacctgtcccctcagtaccaaccccaagcgtcactgagtctttctaatcttccttttctacagacccatctgacctctcccctcttggccaggccgagctaggtcccaattcttcctcagcccctcctcctccaccctataatctttttatcacctcccctcctcacaaccctggtccagcttacagtttcattccgtgactagccctcccccacctgcccagcaatttactcttaaaaaggtggctggagccaaaggcatagtcaaggttaatgctcctttttctttatcccaaatcagatagcgtttaggctctttttcatcaaatataaaagtccagcccagttcatgacttgtttggcagcaatcctgagaaactttacagccctagaccctaaaaggtcaaaaggccgtcttattctcaaaatacattttattacccaatctgctcccgacattaaataaaactccaaaaattaaattccagccctcaaaccccacaacagcatttaattaacctcgccttcaaggtgtacaataatagaaaaaagttgcaattccttgcctccactgtgagacaaaccccagccacatctccggcacacaagaatttccaaaagcctgaaccgcagcagccaggcgttcctccagaacctcctcccacaggagcttgctacacatgccagaaatctggccattgggccaaggaatgcccgcagcccgggattcctcctaagccgcgtcccatctgtgtgggaccccactgaaaatcggactgttcaactcacttagcagccactcccagagcccctggaactctggcccaaggctctccgactgactccttcccagatcatctcggcttagcggctgaagactgacactgcccgatggcctcagaagccccctagaccatcacggacactgagcttccggtaactctcacagtggaaggtaagcccgtccccttcttaatcaatacagaggctacacactccacattaccttcttttcaagggcctgtttcccttgcctccataactgttgtgggtattgacggccaggcttctaaacctcttaaaactccccaacgctggtgccaacttagacaatactcttttaagcactcctttttagttatccccacctgcccagttcccttattaggccgagacactttaactaaattatctgcttccctgactattcctggactacagctgtatctcattgctgcccttcttcccaatccaaagcctcctttgcatcctcctcttctatcccccaccttaacccacaagtataagatacctctactccctccttggcgaccgattatgcaccccttaccatctcattaaaacctaatcacccttaccccaccaaacgccaatataccatcccgcagcacgctttaaaaagattaaagcctgttatcactcgcctgctacagcatggccttttaaagcctataaactctccttacaattcccccattttacctgtcctaaaaccagacaagccttacaagttagttcaggatctgcgccttatcgaccaaattgttttgcctatccaccccgtggtgccaaacccatatactctcctatcctcaatacctgtctctacaacccattattctgttctagatctcaaacatgctttctttactattcctttgcacccttaatcccagcctctcttcactttcacttggactgaccctgacacccatcaagctcagcaaattacctaggctgtactgccacaaagcttcacagacagcccccattacttcaatcaagcccaaatttcttccccatctgttacctatctcggcataattctcataaaaatacatgtgctctccctgccaatcgtgtccgactgatctctcaaaccccagcaccttctacaagacaacaactcctttccttcctaggcatggttagcacagacagaattcttacgcaagagccaggaccacaccgtgtagcctttctgtccaaacaacttgaccttactgttttagcctagccctcatgtctgcgtgcagcggctgccgctgctttaatattgttagaggccctaaaaatcacaaaccattctcaactcactctctacatttctcataacttccaaaatctattttctcctcatacctgatgcatatactttctgcttcccggctccttcagctgtactcactctttgttgagtctcccacaattaccattgttcccggcccagacttcaatccggcctcccacattattcctgataccacacctgacctccatgactgtatctctctgatccacctgacattcaccccatttccccaaatttcctggtttcccgttcctcaccctgatcacgcttgatttattgatggcggttccaccaggcctaatcgccacacaccagcaaaggcaggttatgctatagtacaagccactagcccgcctcttagaacctctcatttcctttccatcatggaaatctatcctcaaggaaataacttctcagtgttccatttgctattctactactcctcagggattattcaggccccctcccttccctacacatcaagctcgaggatttgccccaacccaggactggcaaattagcttttctaaacatgtcctgagtcaggaaactaaaatacctcttagtctaaatagacactttcactgaataagtaaaggcctttcctacagggtctgagaaggccaccacagtcatttcttcccttctgtcaggcataattcctcagtttagccttcccacctctatacagtctgataacagaccagcctttattagtcaaatcagccgagcagtttttcaggctcttagtattcagtgaaacctttatatcccttacggtcctccgtcttcaagaaaagtagaacggactaaaggtcttttaaaaacacacctcaccaagctcagccaccaacttaaaaaggactggacaatacttttaccacttttgcttctcagaattcaggcctgtcctcagaatgctacaaggtacatcccgtttaagctcctgtatagacgcctttttattaggccccagtctcattccagacaccagaccaacttagactgtgcccccccaaaaaaacttgtcatccctactatcttctgtctagtcatactcctattcaccgttctcaactacccatacatgccctgctcttgtttacactgccagtttacactgtttttccaagccatcacagctgatatctcctggtgctatccccaaactgccactcttaactcttgaagtaaataaataatctttgctggcagaactatgctgaatctccttaggcactccctaatcagatatcctgagtcatcccaattcttagaccttttacacctgtttttctccttctgttattccatttagtttctcaattcatccaaaaccgtatccaggccatcacctatcattctatacgacaaacgtttcttctaacatccccacaatatcaccccttaccacaagacctcccttcagcttaatctctcccactctaggttcccacgccgcccctaatcccgcttgaagcagcccttagaaacatcgcccattctctctccataccaccccccaaaaattttcgccgccccaacatttcaacaccattttgttttatttttcttattaatataagaaggcaggaatgtcaggcctctgagcccaagccaagccatcgcatcccctgtgacttgcacgcatatataagcccaggtggcctgaagtaactgaagaatcacaaaagaagtgaatatgccctgccccaccttaactgatgacattccaccacaaaagaagtgtaaatggccggtccttgccttaactgatgacattaccttgtgaaagtccttttcctggctcatcctggctcaaaaagcacccccactgagcaccttgcgacccccactcctgcctgccagagaacaaaccccctttgactgtaattttcctttacctacccaaatcctataaaacggccccacccttatctcccttcactgactctcttttcggactcagcctgcctgcacccaggtgaaataaacagccatgttgctcacacaaagcctgtttggtggtctcttcacacggacgcacatgaaa

SEQ ID NO: 397 - DNA, 981 bp, Homo sapiens
gtggggaaaagcaagagagatcagattgttactgtgtctgtgtagaaagaagtagacataggagactccattttgttatgtactaagaaaaattcttctgccttgagattctgttaatctataaccttacccccaaccccgtgctctctgaaacatgtgctgtgtcaactcagagttaaatggattaagggcggtgcaagatgtgctttgttaaacagatgcttgaaggcagcatgctccttaagagtcatcaccactccctaatctcaagtacccagggacacaaaaactgcagaaggccgcagggacctctgcctaggaaagccaggtattgtccaaggtttctccccatgtgatagtctgaaagatggcctcgtgggaagggaaagacctgaccgtcccccagcccgacacccccagcccgacacccgtaaagggtctgtgctgaggaggattagtaaaagaggaaggaatgcctcttgcagttgagacaagaggaaggcatctgtctcctgcccgtccctgggcaatggaatgtctcggtataaaacccgattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccgcctcttcgagaaacacccacagatgatcaataaatactaagggaactcagaggctggcgggatcctccatatgctgaacgctggttccccgggtccccttatttctttctctatactttgtctctgtgtctttttcttttccaaatctctcgtcccaccttacgagaaacacccacaggtgtgtaggggcaacccacccctaca

SEQ ID NO: 398 - DNA, 436 bp, Homo sapiens
atcaggcctctgagcccaagccacgccaccgcatccctggtgacttgcacgtgtacgcccagatggcctgaagtaactgaagaatcacaaaagtgaaaatgccctgccccgccttaactgatgacattccaccacaaaagaagtgaaaatggccagtccttccttaagtgatgacattaccttgtgaaagtccttttcctggctcaaaaagctcccccactgagcaccttgcgacccccactcctgcccaccagagaacaaatcccctttgactgcaattttcctttatctacccaaatcctataaaacggccccacccttatctcccttcactgactctcttttccgactcagcccgcctgcacccaggtgattaagagctttattgctcacacaaagcctgtttggtggtctcttcacacagacgcgcatgaaa

SEQ ID NO: 399 - DNA, 408 bp, Homo sapiens
gtcaggcctctgggaccaagcctgcacctatacatccagatggactgaaggaagcaaagaaacacaaaggaagtgaaaatggctggttcctgccttaactgatgacattccatcattgtgatttgttactgccccaccttaactgagtgattaaccttgtgaaattccttctcctggctcagaagctcccccactgagcaccttgtgaccccgcccctgcccgcaagagaaaaaccccctttgactgtaattttccactacccacccaaatcctataaaactgccccacccctatctgcctttcctgactctcttttcggactcagcccgcctgcacccaggtgagataaacagcctcgttgcttacacaaagcctgtttggtggtctcttcacacagacgtgtgtga

SEQ ID NO: 400 - DNA, 3476 bp, Homo sapiens
ggctctggaaaagggaagagctgggcaaactgaatgctaatagggcttgcttccagtgcggtctacaaggacactttaaaaaagattgtccaaatagaaataagccgccccctcgtccatgtcccttatgtcaagggaatcactggaaggcccactgccccaggggatgaaagtcctccgagtcagaagccactaaccagatgatccagcagcaggactgagggtgcccgggccaagtgccagcccatgccatcaccctcacagaaccccgggtatgcttgaccattgagggtcaggaggttaactgtctcctggatgctggcacgaccttctcagttttactctcctgtcccagacaactgtcctccagatctgtcactatccaaagggtcctaggacaggcagtcactagatacttctcccagccactaagctgtgactggggaactttattcttttcatatacttttctaattatgcctgaaagccccactcccttgttagggagagacattctagcaaaagcaggggccattatacacctgaacataggagaaagaacatccatttgttgtcccctgcttgaggaaggaattaatccatcctgaagtctgggcaacagaaggacaatatggacgaacaaagaatgcctgtcctgttcaaattaaactaaaggattctgcctcctttccctaccaaaggcagtaccctcttagacccaaggcccaacaaggactccaaaaaattgttaaggacctaaaagcccaaggcctagtaaaaccatgcaatagctcctgcaatactccaattttaggagtacagaaacccaacagacagtggaggtcagtgcaagatctcaggattatcaatgaggctcttatccctctatacccagctgtacctaacccttgtactctgctttcccaaataccagaggaaccagagtggtttacagtcatggaccttaaggatgcctttttctgcatccctgtacatcccaactctcaattcttctttgcctttgaagatccttcaaacccaacgtctcaactcacctggactgtcttatcccaagggttcagggatagcccccatctatttggccaggcattagcccaagactttagccagttctcatacttggacactcttgtcctttggtacgtggatgatttacttctagccgcccattcagaaaccttgctccatcaagccacccaagcgcttttaaacttccttgccacttgtggctacaaggtttccaaaccaaaggctcagctctgcttacagcaggttaaatacttaaggctaaaattatccaaaggcactagggccctcagtgaggaatgtatccagcatatactggcttatcctcatcccaaaaccctaaagcaactaagagggctccttggcataacaggcttctgccgaatatggattcccaggtatggcaaaatagtcaggccattaaatacactaattaaggaaactcagaaagccaatacccatttagtaagatggacacctgaagcagaagcggctttccaggccctaaggaaggccctaacccaagccccagtgttaagcttgccaacggggcaagacttttctttatatgtcacagaaaaaaaataggaatagctctaggagtccttacacaggtctgagggaccagcttgcaacctgtggcatacttgagtaagaaaattgatgtagtggcaaagggttggcctcattgtttacaggtagtggcagcagtagcagtcttagcctccgaagcagttaaaataatacaaggaagagatcttatgtgtgtggacatctcatgatgtgaacagcatactcactgctaaaggagacttgtggctgtcagacaaccattagcttaaatatcaggctcttatttgaagggccagtgctgcgactgcgcacttgtgcaactcttaacccagccacgtttcttccagacaatgaagaaaagatagaacataactgtcaacaggtgattgctcaaacctacgccgctcgaggggaccttctagaggttcccttgactgatcccaacctcaacttgtatactgatggaagttcctttgtgaaaaaaggacttcaaaaagtggagtatgcagtggtcagtgataatagaatacttgaaagtaatcccctcactccaagaactagcattcagctggcaaaactaatagccctcactcgggcatcagaattaggaaaaggaaaaatggtaaatatatatacagactctaagtatgcttacctagtcctccatgcccacacagcaatatggagagaaagggaatttctaacttccgagaacacctatcaaacatcaggaagccattaggagattattattggctctacagaaacctaaagaggtggcagtcttacactgccggggtcatcagaaaggaaaggaaagggaaatagaagggaaccgccaagcggatattgaagccaaaagagctgcaaggcgggaccctccattagaaatgcttatagaaggacccctcttatggggtaaccccctccaggaaaccaagccccaatactcagcagaagaaatcgaatggggaacctcacgaggacatagtttcctcccctcaggatggctagccacgaaagaaggaaaaatacttttgcctgcagctaaccaatggaaattacttaaaacccttcaccacacctttcacttaggcattgatagcacccatcagatggccaaatcattatttactggaccaggccttttcaaaactatcaagcagatagtcaaggcctgtgacgtgtgccaaagaaataatcccctgcactgcagggtattatttgaatacatttgaatccctgtatctttaacctccttgttaagtttgtctcttccagaatcaaaggtgtaaaactacaaatcgttcttcaaatggagccccagatgcagtccatgactaagatctaccgaggacccctggaccagcctgctagaccatgctccaatgttgatgacatcgaaggcacccctcccaaggacccctgcatgacccctactacactccaattcagcaggaagcagttagagcggttgtcggccaacctccccaagagcacttgggttttcctgttgagaggaggtaccgagagacaagactagctggatttcctaggccgactaagaatccccaagcctagctgggaaggtgacgcatccacctttaaacacagggcttgcaacttagctcacacccaaccaatcaagtagtaaagagagctcactaaaatgctaattaggcaaaaacaggaggtaaagaaatagccaaacatctatcgcctgcctgagagcacaggggaaggaacaatgatcgggatataaacccaggcatttgagctggcaatggctacccactttgggtcccctccctttgtatgggagctctgttttcactctattacatcttgcaactgca

SEQ ID NO: 401 - DNA, 970 bp, Homo sapiens
gtggggaaaagagagatcagactgttactgtgtctgtgtagaaagaagtagacataagagactccattttgttctgtactaagaaaaattcttctgccttgagatgctgttaatctgtaaccctaccctcaaccctgtgctccctgaaacacgtgctgtgtcaactcagggttaaatggattaagggctgtgcaggatgtgctttgttaaacaaatgcttgaaggcagcatgcttgttaagagtcatcaccactgcctaatctcaagtacccagagagacagtacactgcggatggctgcatggacctctgcctaggaaagccaggtattgtccaaggtttctccccatgtgatagtctgaaatatggcctcgtgggaagggaaagacctgaccattccccagcccgacacccacacccgtaaagggtctgtgctgaggcctctttgcagttgagataagaggaaggcatctgtctcctcctcatccctgggcaatggaatgtctccctgtaaagcccgattgtatattccatctactgagataggggtaaaccgccttagggctggaggtggcacatgctggcagcaatactgctctttaaggcattgagatgtttatgtatatgcacatcaaaagcacagcacttttttctttaccttgtttatgatgcagagacatttgttcacatgttttcctgctgaccttctctccactattaccctattgtcctgccacatccctctctccaggcacatccctctctcaggtaaatgcctgataatgatcaataagtactaaaaggaaactcagaggcctgtgccggcgcaggtcctccatatgctgagtgccggtcccctgggcccatttttgtttctctatgtcttgtctctgtgtctctttcttttccaagtctctcgttccacctgacgagaaacgcccacaggtgtggaggggcaacccatcccttca

SEQ ID NO: 402 - DNA, 528 bp, Homo sapiens
ggcacgggtcctccgtatgctgagcgccggtcccctgggcccacttttctttctctatactttgtgtctctttcttttctcagtctctcgtcccacccgactggaaacacccacaggtgtggaggggcaggccaccccttcatctggtgcccaacgtgggtgcttttctctaggttgaaggtatgctcgagcatgatcattgaggacaagtcgacgagattcccgagtacgtctacagtcagccttgtgacatttgaagttctacaatgaacccgtcggagatgcaaagaaaagcacctccacggagacagagacaccgcagtcgagcaccatcggctcacaagatgaacagaatggtgatgtcagaagaacagatgaagttgccatccaccaagaaggcggagccgccgacatgggcacaattaaagaagctgacacagttagctaaaaaaaagcctagagaacacaaaggtgacacaaactccagagaacatgctgcttgcagctttgaagactgtatcaacagtg

SEQ ID NO: 403 - DNA, 5882 bp, Homo sapiens
gtcaggcctctgagcccaagctaagccatcatatcccctgtgacctgcatgtacacacccagatggctggttcctgccttaactgatgacattccaccacaaaagaagtgaaaacggcctgttcctgccttaactgatgacattgtcttgtgaaattccttctcctggctcatcctggctcaaaagctcccctactgagcaccttgtgacccccaatcctgcccaccagagaacaacccccctttttcctttacctacccaaattctataaaatggccccacccctatctccctttgctgactctctttttggactcagcccacctgcacccaggtgattaaaagctttattgctcacacaaagcctgtttggtggtctctttacacagacgcgcatgaaatttggtgccgtgactcagatcgggggacctcccttgggagatcaatcccctgtcctcctgctctttgctctgtgagaaagatccacctacgacctcaggtcctcagaccgaccagcccaagaaacatctcaccaatttcaaatctggtaagcggcctctttttactctcttctccaacctccctcactatccctcaacctctttctcctttcaatcttggcgccacacttcaatctctcccttctcttaatttcaattcctttcattttctggtagagacaaaggagacatgttttatccgtggacccaaaactccggcgcgggtcacggactgggaaggcagccttcccttggtgtttagtcattccagggatgcctctctgattattcacccatgtttcagaggtgtcagaccacgcagggacgcctgccttcgtccttcacccttagcggcaagtcccacttttctagggggcaagaacccccaatcccttatttccacaccccaaccttttatctctgcaccctgatcccttatttccatggcctgacctcttatctctgcaccccaaccccttatttccatgccccaacccgtttcctgcttttctggagggtaagaactcccgaaccccttccctccatgtctctacccttctctttaaacctgcctccttcactataggcaaccttccaccttccattcctccttcttctcccttagcctgtgttcttaagaacttaaaacctcttcaactctcacctgacctaaaatctaagcttcttactttcttctgaaatgctgtttgacccaatacaaactcgacagtagttccaaatagccagaaaacggcactttcaatttttccatcctacaagatctaaataattcttgtcgtgaaatgggcaaatggtctgaggtgcctgacgtccaggcattcttttacacatcaggccctccctagtctctgttcccaatgcaactcatcccaaatcttccttctttccctcccacctgtcccctcagtcccaaccccaagtgttgctgagtctttctaatcttccttttctacagacctatctgacctctcccctccttgccaggccaagctaagtcccatttcttcctcagcctccgctccaccaccctataatccttttatcacctcccctcctcacacgcagtccggcttacagtttcattctgtgactagccctcccccacctgcccagcaatttcctcttaaaaacgtggctggagctaaaggcatagtcaaggttaatgttcctttttctttatcccaaatcagatagcgtttaggctctttttcatcaaatataaaaacccagcccagttcatggctcgtttggcagcaaccctgagacgctttacagccctagaccctaagaggtcaaaaggccgtcttacactcaatatacattttattacccaatctgctcccgacattaaataaaactccaaaaattaaattccggccctcaaactccacaacaggacttaattaacctcaccttcaaggtgtacaataatagaaaaaagttgcaattccttgcctccactgtgagacaaaccccagtcatatctccagcacacaagaacttccaaacacctaaactgcagtggccaggcattcctccagaacctcctcccccaggagcttgctacaagtgccaaaaatctggccaccaagccaaggaatgcccgcagcctgggattcctcctaaatgtcctatctgtgctggaccctactggaaatcggactattcaactcacctggcagccactcccagagcccctggaactctggcccaaggctctctggctgactacttcccagatcttcttggcttagcagctgaagactgacactgcccgattgcctcggaagccccctagaccatcacggatgcccagcttcggttaactctcacagtggagggtaagtccgtccccttcttaatcaatacagaggctacccactccgcattaccttcttttcaagggcctgtttcccttgcttccataactgttgtgcgtattgacagccaggcttctaaacctcttaaaactccccaactctggtgccaacttagacaatactcctttaagcactcctttttagttatccccacctgcccagttcccttattaggccgagacactttagctaaattatctgcttccctgactattcctggactacagctacatctcattgccgcccttcttcccaatccaaagcctcctttgcgtcctcctcttgtatccccccaccttaacccacaagtataagatacctctactccctccctggtgaccgatcatgcaccccttaccatctcattaaaacctaatcacccttaccccactcaatgccaatatcccatcccacaccatgctttgaaaggattaaagcctgttatcacttgcctgctacaccatggccttttaaagcctataaactcaactctccttacaaatcccccattttacctgtcctaaaaccagataagccttacaagttagttcaggatctatgccttatcaaccaaattgttttgcctatccaccctgcagtgcccaacccgaacactcttttgtcctcaatagcttcctccacaactcactattctgttcttgatcttaaagatgcttttttcactattcccctgtacccctagtcccagcctctctttgctttcacctggactgaccctgacacccatcagtgccagcagcttgcctgggctgtgcggccataaggcttcagggacggccctcattacttcagccaagctctttctcatgatttactttctttccacccctccgcttctcaccttattcaatatattgatgaccttcttctttgtagcccctcctttgaatcttctcaacgagacacacttctgctccttcagcatctattctccaaaggatatcgggtatctccctccaaagctcaaatttcttctccatccattacctacctcggcataattctgcataaaaacacacatgccctccctgctgatcgtgtcccactaatctctcaaaccccaaccccttctacaaaacaacaactcctttccttcctgggcatggttggatactttcgcctttggatacctggttttgccatcctaaaaaaaccattatgtaaactcacaaaaggaaacctagctgaccccatagatcctaaatcctttcctcactcctctttccgttccttgaagacagctttagagactgcccccatcctagctctccctgactcatcccaaccctcttcattacacacagccgaagtgcagggctgtgcagttggaattcttacacaaggaccaggatcgcatcctgtagcctttttgtccaaacaacttgaacttactgttttaggctggccatcatgtctccgtgcagtggctgctaccgccctaatacttttagaggcccttaaaatcacaaactatcctcaactcactctctacggctctcataatttccaaaatctattttcttcctcacacctgacacatatactttctgctctccggctccttcagctgtactcactctttgttaagtcccataattaccattgttcctggcctggacttcaatccagcctcccacattattcctgataccacacctgaccctcatgactgcatctctctgatccaaatgacgttcaccccatttccccacatttccttcttccctgttcctcacccttatcacgcttagtttattgatggcagttccaccaggcctaatcgccacgcaccagcaaaggcaggctatgctatagtacaagccactagcccgcctcttagaacctctcatttcctttccatcgtggaaatctatcctaaaagaaataacttatcagtgtttcatctgctattctactacttctcagggattattcaggacccctcccttccctacacattaagctcagggatttgcccccacccaggactggcaaattagctttacttaacatgccccaagtcaggaaactaaaatacctcttggtctaggtagacactttcactggataggtagaggcctttcccacagggtctaagaaggccaacatggccatttcttcccttctgtcagacataattcctcggtttggccttcccacctctatacagtccgatagcagaccagcctttattagtcaaatcagccaagcattttttcaggctcttagtattcagtgaaacctttatatcgcttacagtcctcagtcttcaggaaaggtagaacagactaatggtcttttaaaaacacacctcaccaagctcagccaccaacttaaaaaggactggacaatacttttaccactttcccttctcagaattcagacctgtcctcagaatgctacaaggtacagcccatttgggctcctgtatagacgctcctttttattaggccctgctctcattccagacagcagaccaacttggactgtgccccaaaaaacttgtcatccctactatcttctgtctagtcatactcctattcaccgttctcaactactcatacatgccctgctcttgtttacactgccggtttgcactgtttctctaagccatcacagctgatatctcctggtgctatccccaaactgccactcttaacttttaaagtaaataaataatctttgctggcaaggctatgctgaacctccttaggcactctctaattaaatgtcctaggtcctccaaattcttagacctttaatacctgtttttctccttatcttactccgtttttcaattcatacaaaaccgtatccaggccatcaccaataattctaaatgacaaatgtttcttctaacaaccccacaatatcaccccttaccacaaaatcttccttcagcttaatctctcccactctaagttcccacaccgcccctaatcccactcgaagcagccctgagaaacatcgcccattatctctccataccacccccaaaaacttttcactgtcccaacactttaccactatttcattttatttttcttattaatataagaagacaggaatgtcaggcctctgagcccaagctaagccatcatatccccgtgacctgcacgtacacatccagatggccagttcctgccttaactgatgacattccaccacaaaagaagtgaaaatggcctgttcttaccttaactgatgacattgtcttgtgaaattccttctcctggctcatcctgcctcaaaagttcccctactgagcaccttgtgacccccactcctgcccaccaaagaacaacccccctccttcctttacctacccaaatcctataaaaccccatctcccttcgctgactctctttttggactcagcccgcctgcacccaggtgattaaaagctttattgctcacacaaagcttgtttggtggtctcttcacacggacgcgcatgaaa

SEQ ID NO: 404 - DNA, 263 bp, Homo sapiens
ttacagtaggtagctagtcaggcatgaacagggcaggagagggctccaccttcctccccccgccacacaccaggaatgtcaagcgatcatcagatgatagtcaggcagttgttaactgtctctctaaaataataattggttacagccagtgccagagaaaggcagtctcctgatagatagaaaatacctgaaactggtgatcagcagcttcctgataagatctcagaaattgggcaagtggcctcaagcatgcactcttaggg

SEQ ID NO: 405 - DNA, 408 bp, Homo sapiens
gtcaggcctctgagcccaagctaagccatcacatcccctgtgacctgcaagtacacatccagatggcctgaagtaactgaagaatgacaaaagaagtgaaaatggcctgttcctgccttaactgatgacattaccttgtgaaattccttctcctggctcatcctggcttaaaagctcccccgctgagcaacttgtgacaccccctccccaccttgcccctgcccgccagagaaccccctttgactgtaattttcctttacctacccaaatcctataatatggccccacctcatctccctttgctgactctcttttcggactcagcccgcctgcacccagatgaaataaacagccttgttgctcatacaaagcctgttaggtggtctcttcacggggacaggagtgaaa

SEQ ID NO: 406 - DNA, 5170 bp, Homo sapiens
gtcaggcctctgagcccaagccaagccatcgcatcccctgtgacttgcatgtatacatccagatggcctgaagtaactgaagatccacaaaagaagtaaaaatagccttaactgatgacattccaccattgtgatttgtttctgccccaccctaactgatcaatgtactttgtaatctcccccatccttaagaaggtactttgtaattctccccacccttgagaatgtactttgtgagatccacccctgcccgcaaaacattgctcttaacttcaccacctatcccaaaacctataagaactaatgataatccactaccctttgctgactctcttttcggactcagcccgcctgccgccaggtgaaataaacagccatgttgctcacacaaagcctgtttggtggtctcttaacacggacgcgcatgaaatttggtgccgtgactcggatcgggggacctcccttgggagatcaatcccccgtcctcctgctctttgctctgtgagaaagatccacctatgacctcaggtcctcagactgaccagcccaagaaacatctcaccaatttcaaatccggtaagtggcctctttttactctctcctctaacttcccttactatccctcaacctctttctcctttcagtcttggcgccacacttcactctctcccttctcttaatttcagttcctttcattttctggtagagacaaaggagacacgttttatccgtggacccaaaactccagcgccagtcacagactgggaaggcagccttcccttggtgtttaatcttttcaggaatgcctctctgattattcactcacatttcaaaggtgtcagaccacacagggacgcctgccttggtccttcacccttagtggcaagtcccacttttctgggggaggggcaagtaccccaaccccttctctccatgtctctaccccttctctgcttttctgggggagggacaagtacccctcaaccccttctccttcacccttagtggcaagtcccgcttttgtagtgggcaagaacccccgatcccttatttccacaccccaacctcttatctctgcaccctaatcccttatttccacaccctgacccctttcccacttttctggagggtaagaacccccgaactacttccctccatgtctctactcttccttttctttaaacttgcccccttcactatgggcaaccttccaccctccattcctccttcttctcccttagcctgtgttctcaagaacttaaaacctcttcaactcacacctgacctaaaacctaaatgccttattttcttctgcaatgccgcttgaccccaatacaaacttgacagtagttccaaatagccggaaaacggcactttcaatgtttccatcctacaagatctaaataattcttgtcgtaaaatgggcaaatggtctgaggtgcttgatgtccaggcattcttttacatgttggtcccttcctagtctctgtgcccaatgcaactcatcccaaatcttccttctttccctcccgcctgtcccctcaatcccaaccccaagcgtcactgagtctttctaatcttcctcttctacagacccatctgacctctcccctcctcgccaggctgagctaggtcccaattcttcctcagcctctgctcctccaccctataatccttttatcacctcccctcctcacactccgtccggcttacagttctgtgactagccctcccccacctgcccagcaatttactcttaaaaaggtggctacagataaaggcgtagtcatggttaatgctccttttctttatcccaaatcagatagcgtttaggctctttttcatcaaatataaaaacccagcccagttcgtggctcgtttggcagcaaccctgagacgctttacagccctagaccctaaaaggtcaaaaggccgtcttattctcaatatacattttattacccaatctgctcccgacattaaataaaactccaaaaattggaagctggccctcaaaccccacaacaggacttaattaacctcaccttccaggtgtacaataatagaaaaaagttgcaattccttgcctccactgtgagacaaaccccagccacatctccagcacacaagaacttccaaacgcctgaaccacagcagccaggcgttcctccagaacctcctcccccaggagcttgctacacatgctggaaatctggccactgggccaaggaatgcccgcagcccaggattcctcctaagccatgtcccatctgtgtgggaccccaatgaaaatcggactgttcaactcacctggcagccactcccagagcccctggaactccggcccaaggctctctgactgactccttctcggcttagcagctgaagactgatgctgcccgatcgcctcagaagccctgtagcccatcacagatgccgagcttcgggtaactatcacagtggaaggtaagtctgtccccttaatcaatatggaggccacccactccacagtaccttcttttcaagggcctgtttcccttgcctccatgcctccataactgttgtgggtattgatggccaggcttctaaacctcttaaaattccccaactctggtgccaacttagacaatactcttttaagcactccttttttagttatccccacctgcccagttcccttattagactgagacactttaactaaattatctgcttccctcactattcctggactacagctacatctcattgctgcccttcttcccaatccaaagcctgttatcactcgcctgctacagaatggccttttaaagcctataaactctccttacaattcccccattttacctgtcctaaaatcagacaagccttacaaattagttcaggatctgcgccttatcaaccaaattgttttgcctatccaccctgtagtgccaaacccatatactctcctatcctcaatacctccctctacaacccattattctgttctagatctcaaatatgctttctttactattcctttgcacccttcattccagcgtcacttcgctttcacttggactgaccctgacacccatcaagctcagcaaattacctaggctgtactgccgcaaaccttcacagacagcccccattacttcagtcaagcccaaatttcatcctcatctgttacctatcttggcataattctcataaaaacacacgtgctctccctgctgatcgtgtcccattaatctcccaaacctcaatcccttacaaaacaacaactcctttccttcctaggcatggttagtgcagtcagaattcttacacaagagccaggaccacaccctgtagcctttctgtccaaacaacttgaccttactgttttagcctagccctcatgtctgcatgcagcggctgtcgctgctttaatacttttagaggccctaaaaatcacaaacaatgctcaactcactctctacatttctcataacttccaaaatctactttcttcctcatacctgacgcatatactttccactccctggctccttcagctgtactcactctttgttaagtcccacaattaccattgttcctggcccggacttcaatctgacctcccacattattcctgataccacacctgacccccatgactgtatctctctgatccacctgatattcacctcatttccccatatttccttctttcctgttcctcaccctgatcacgcttgatttattgacggcagttccaccaggcctaatcgccacctaccagcaaaggcaggctatgctatagaacaagccactagcccgtctcttagaacctctcatttcctttccatcatggaaatctatcctcaaggaagtaacttctcagtgttccatctgctattctactactcctcagggattattcaggccccctcccttccctacacatcaagcttgaagatttgcccccacccaggactggcaaattagctttactcaacatgccccgagtcagataactaaaatgcctcttagtctaagtagacactttcgctagataagtagaggcctttcctacagggtctgagaaggccaccgcagtcatttcttcccttctgtcagacatagttcctcagtttagccttcccacctctatacagtctgaaaacagaccagcctttattagtcaaatcagccaagcagtttttcaggctcttagtattcagtgaaacctttatatcccttacggtcctccgtcttcaagaaaagtagaatggactaaaggtcttttaacaacacacctcaccaagctcagctaccaacttaaaaaggactggacaatacttctaccactttcccttctcagaagtcagacctgtcctcagaatgctataaggtacagcccatttaagctcctgtatagacgctcctttttattaggcaccagtctcattccagacaccagaccaacttagttagactgtgccccaaaaaaacttgtcatccctattatcttctgtctagtcatactcctattcaccgttctcaactactcatacatgccctgctcttgtttacactgtttctccaagccatcacagatgatatctcctggtgctatccccaaaatgcagctctaaactcctgaagtaaataaataatctttgctggcaggactatgcggaacctccttaggcactctctaattagatgtcctaggtcctcccaattcttagaccttttatacctgtttttctccttctcttattccatttagtttctcaattcatacaaaaccatatccaggccatcaccaatcattctatacgacaaatgcttcttctaacatccccacaatatcaccccttaccacaagatctcccttcagcttaatctctcccactctaggttcccacgccgcccctaatcccgcttgaagcagccctgagaaacatcgcccactctctctccataccacctcccaaaaattttcgccgccccaacacttcaacactattttgttttatttttcttataaatataagaaggcaggaatgtcaggcctctgagcccaagccaagccatcgcatcccctgtgacttgcatgtatacatccagatggcctgaagtaactgaagatccacaaaagaagtaaaaatagccttaactgatgacattccaccat

SEQ ID NO: 407 - DNA, 665 bp, Homo sapiens
ttaaagtaggtagctagtcaggcatgagaagtgtaagagagggctccccccactccatcaggaatgtcaggcgaccatcaggtgatggtcaggcagttgtcacactgtctctctaaaataataattagtcacagccagtgccagggaaaggcagtctccatagataaaaacacctgaaactggtgatcagcagcttttggataagatttcagcagttgggccagtaggctcgagcatgcatattaagagccaaaatggtaccatttaactggtatataaccatcgggggcattccactggtaaggaaagaatgcctcaaatgagcatgcatacaactccagtaaacacactgctcgtgctcccctcccaagtgctagcaggccactgtgcatgtggacaacccactctgagggaagaatcagggaagaagggacgcaagaccccagaagagtgttaatatataaaaccccaagtcaaaaggtcaaactgtgcacttgtctatcaagttgcctgcttggccctctaccaagtatatgttctttccttttgttcctgctctaaagctttttaataaactttcacttctgctctaaaccttgccttggtctctccttctgccttatgcctccttggtcgaattctttcttctgagggggcaagaattg

SEQ ID NO: 408 - DNA, 704 bp, Homo sapiens
ttacagtaggtagttagtcagacataaacaggacaggagagcccctagccctcaggaatgccaggcaaccatcaggtgatgggcaggcagttgttaaactgcctctctaaaataataattggctgcagctgattcaagggaaacagggtctcccaatagacagaaacacctaaagttggtgatcagcagcttcctgataaaatctcaagggttgggtaagtgggctcaagcatgcagccctcaaaaatagcagagtttaactggtatatgaccttcccctaagaacatttgaccagtaaagaaagaacgcctcaagtgagcatatgcatgatttttggtaaacacattgcacatgctcacctcccaagtgctggcaggcaactgtgcatccagacagcccacctcaagggaagaatcaggtgagaagtaatgcaacctcagaagcatgctaaccccaagtcaaaggtcaagccacgcatttgatctctcaagtcgcctgctaggacctcttccaagtgtactttacttctttttgttcctgctctaaagcattttaataaactttcattcctgctctaaagcttgccttggtctctcactctgccatgtgctcctcagtcaaattctttcttctgaggaggcaagcatttgaggttgctgcagacccatacagattcactgccactaacatactttagtgctac

SEQ ID NO: 409 - DNA, 6255 bp, Homo sapiens
gtcaggcctctgagcccaagctaagccatcatatgcctgtgtatatgcctatgacctgcatgtacacatccagatggccggttcctgcgttaactgatgacattccaccacaaaagaagtgaaaatggcctgttcctgccttaactgatgacattatcttctgaaattccttctcctggctcatcttggctcaaaagctcccctattgagcaccttgttacccccactcctgcccgccagagaacaacccccctttgatgtaattttcctttacctacccaaatcttataaaacagccccaccccatctcccttcgctgactctctttgcagactcagcccacctgcacccaggtgaaataaacagccttgttgctcacacaaagcctgttttgtggtctcttcacacggatgcgagtgaaatttggtgctgtgactcggatcaggggacctcccttgggagatcaatcccctgtcctcctgctctttattccatgagaaagatccacctatgacctctggtcctcagaccaactagcccaaggaacatctcaccaattttaaatccagtaagtggcctctttttactctcttctccaacctctctcactatccctcaacctctttctcctttcaatcttggcatcacccttcaatctctctcttaatttcagttcctttccttttctgacagagatgaaggagacgcgttttattcatagacccaaaactccggcaccagtcacggaattgggaagacagtcttccctttggaatcaggcagggatgcctgcctgattattcacccatgtttcagaggtgtctgaccatgtggggacacctgccttggtccttcacccttagcgacaagtactgcttttcttgggagcaagaacccccaaccccttctctccgtgtctctactccttctctgcttttctggggggcaagaaccccaccgcttttctccatgtctctaccccttctccgcttttctggggggcaagaaccccccaaccccttctccttcacccttagcggcaagtaccgctcttcttgggggcaagaacccccaaccccttctctccatgtctctactctctcttctctctgggcttgcctccttcactatgggcaagcttccgccctccattcccccttcttctcccttagcctgtgctcttaaaaacctaaaacctcttcaattcacagctgacctaaaacctaaatgccttattttcttctgcaatgccacttgaccccaatacaaactcgacagtagttccacatagccagaaaatgtcactttccatttttccatcctacaagatctaaataattcttgttgtaaaataggcaaacggtctgaggtgcctgacgtccaggcattcttttacacattggtccctccctagtctctgttcccaatgcaactcatcccaaatcttccttctttccctcccgcctgtcccctcagtcccaaccccaagcatcgctgagtctttctaatcttccttttctacaaacccatgtgacctctcgcctcctcaccaggccgagctaggtcccaattcttcctcagcctccacttctccaccctgtaatccttttatcacctcctctcctcacacctggcccagcttacagtttcattccatgactagccctccccaacctgttcagcaatttcctcttaaaaaggtggctggagctaaaggcatagtcaaggttaatgttcctttttctttatcccaaatcagatagcgtttaggctctttttcatcaaatataataacccagcccagttcatggctcgtttggcagcaaccctgagacgctttacagccctagatcctaaaaggtcaaaaggccgtcttattctcaatatacattttattacccaatctgctcccgacattaaataaaactccaaaaattaaattccagtcctcaaaccccacaacaggacttaattaacctcgccttcaaagtgtacaataataaagtagaggcagcaaagtagcaacatatttctgagttgcaattccttgcctccactgtgagacaaaccccagccacatctccagcacgcaagaacttccaaacgcctaaaccacagtggccaggcattcctccaggcctgcctcccccaggagcttgctaaaagtgccagaaatctggccacctggccagagaatgcccgcagcccaagattcctcctaagccatgtcccatctgtgcaagaccccactggaaatcagactgtccatctcaccggcagccactcccatagcccctggaactctgccccaaggctctctgactgactccttcccagatcttctcggcttaacaactgaagactgtcactgcccaatcacctcagaagcctacaggaccatcacagacactctaggtaactctcacagtggagggtaagcccgtccccttcttaatcaatacggaggctacccactccacattaccttcttttcaaaggcctgtttcccttgccttcataactgttgtaagtactgatggccaggcttctaaacctcttaaaactccccaactcttgtgccaacttagacaatactcttttaagcactcctttttagttatccccacctgcctagttcccttattaggctgagacactttaactaaattatctgcttccctaactattcctaggctacagccacacctcattgccaccttttcccccaggtcaaagcctccttcacatcctccccttgtatctccccaccttaacccacaagtataggacacctctactgcctccttagcgactgatcctgcaccccttaccatcccattaaaacctaatcaccttaccccgctcaatgccaatatcctatcccacagcacgctttaaaaggattacagcctattatcactctcctgctacagcatggccttttaaagcctataaactccccttacaattcccccattttacctgtcctaaaaccagacaaggcttacaggttagttcaggatctgtgccttatcaaccaaattgttttgcctaaccaccccatggtgccaaatccatatactctcctatcctcaatatctccctccacaacccattattctgttctgggtctcaaacatgctttctttactattcctttgcacccgtcatcccagcctctcttcactttcacttggactgaccctgacacccatcagactcagcaaattacctaggctgtattgccgcaaggcttcacagacagcccccattacttcagtcaagcccaaatttcttcctcatctcttacctatctcagcataattctcataaaaacacatgtgctctccctgctgatcatgtccggctaatttcccaaaccccaatcccttctacaaaacaacaactcctttccttcctaggcatggttagggcagtcagaattcttacacaagagctgggaccgcaccctgtagcctttctgtccaaacaacttgaccttaccattttagcctagccctcatgtctgcatgcagtggctgccgctgctttaatacttttagaggcccaaaaaatcacaaactatgcccaactcattctctacggttctcataatttccaaaatctattttctttctcccacctgacgcatacactttctgctccctggctccttcagctacactccctttttgttaagtctctgacaattaccattgttcctggcccagacttcaatccagcctcccacagtattctggataccacacctgacccctatgactgtatctctctgattcacctgacattcaccccttttcctcatatttccttctttcgtgttcctcaccctgaacacacttagtttattcatagtagttccaccaggcctaatcgccacacaccagcaaaggcaggctatgctatagtacaagtcaccagcccacctcttagaacctctcatttcctttccatcgtggaaatctatcctcaaggaaataacttctgttccatctactattctactcctcctcatagattattcaggccccctcctttccctacacatcaagctcgaggatttgcccccacccaggactggcaactcttaactccctctcagaggggatagataatctttgctggcaggggaccctccaatactttcaccctgatgaagttctattctttacttttatactcaatcttattctcattcccattcttatgccaccctctacctctccccagctatctccaccacactataaacattactcattctctcctagctgtttctaatccctccttagcgaacaaactctagctttgcatttccctttcttccaatgcctacacagctgtccccaccttacatgcagactaggcaacatctcctgtctcctacacctccaaacttcctttaacagccctcacctttaccctcctgatgaactcatttactttctagacaggtccagctagacctccccagacatttcacgtcagcaagctgccgccctcctccacacttacttaaaaaacctttctccttgtatcaactctactccccccgtatttacctctcacaacacaaactactattcctgtggctgctcctttatgtatctctcagcaaagacccactggaattcccctgggtaacctttcactttgatgttcctttactcttcatctccaaagccctcttgttgtttacttatacccagccccataaataacagtgaaaggtagctcatagacactcaacattttctcatacaccatgaaaatcgaacctccccctctacgcagttaccccaccagtccccattacaacctctgatggctgctgccctagctggatccccaggagtctgggtacaagacacccctttcagcactccttctcatctttttactttgcttctccagttttgcctcgcacaaggtctcttcttcctctgtggatcctctacctccatgtgtctacctgctaattggacaggtacatgcacactagttttccttactcctaaaattcaatttgcaaataggaccgaagagctccctgttcccctcatgacaccgacacgacaaaaaagagttattccactaattcccttgcttatcagtttaagactttctgcctccactattgctctcggtactggaataggaggcatttcaacctctgtcacgaccttccatagcctctctagtgtcttctctgctagcatcacagacatatcacaaactttatcagtcctccaggcccaagttgactctttagctgcagttgtcctccaaaaccgctgaggccttgacttagtcactgctgaaaaaggaggactctgtatattcttaaatgaagagtgttgtttctacctaaatcaatctggcctggtgtatgacaacataaaaaactcaaggatagagcccaaaaacttgccaaccaagtaagtaattatgctgaacccccttggacactctctaattagatgtcctaggtcctcccaattcttagtcctttaatacctgtttttctccttctcttattctgtttagtttttcaattcatacaaaaccgtatccaggccatcacgaataattctaaatgacaaatgtttcttctagcaactccacaatatcaccccttagcatgaaatcttccttcagcttaatctctcccactctaggttcccacatcgcccctaatcccgctggaagcagccctgagaaatatcgcccgttatctctccataccaagcccccaaaatttttgccgtcccaacactttaccactatttcatttttattttcttattaatataaggagacaggaatgtcaggcctctgagcccaagctaaaccatcctatcccctgtgacctgcacatacacatccagatggccggttcctgccttaacagatgacattccactacaaaagaagtgaaaatggtctgttcctgccttaactgatgacattataaaattccttctcctggctcatcctggctcaaaagctcccccactgagcaccttgtggcccccactcctgtccgccagagaacaagccccctttgactgtaatttcccactacctacccaaatcttataaaacagctccacccctatctcccttcgctgactctcttttcggactcagcccacctgcacccaggtgaaataaacagccttgttgctcacacaaagcctgtttggtggtctcttcacacggatgtgagtgaaa

SEQ ID NO: 410 - DNA, 5730 bp, Homo sapiens
gtcaggcctctgagcccaagctaagccatcatgtctcctgtgacctgcacgtacacatccaggtggctggttcctgccttaactgatggcattccaccacaaaagaagtgaaaatggcctgttcctgccttaactgatgacattgtcttgtgaaattccttctcctggctcatcctgactcaaaagctcccctactgagcaccttgtgaccactactctgcttgccagagaatgacccccctttgactataattttcctttatctacccaaatcttataaaacggccccacccctatctcccttcgctgactctcttttcggactcagcccgcctgcacccaggtgattaaaagctttattgctcacacaaagcctatttggtggtctcttcacacggacgtgcatgaaatttggtgccatgactcggatgggggacctcccttgggagatcaatcccccgtcctcctactctttgttctgtgagaaagatccacctatgatctcaggtcctcagaccaaccagcccaagaaacatctcaccaatttcaaatccggtaagtggcctctttttactctcttctccaacctccctcactatccctcaacctctttctcctttcaatcttggtgccacacttcaatctctcccttctcttaatttcaattcctttcattttctggtagagacaaaggagacacgttttatccatggacacaaaactccggcaccggtcacggactagggaaggcagccttcccttggtgtttaatcattgcagggatgcctctctgattattcacccaggtttcagaggtgtcagaccacgcagggacgcctgccttggtccttcacccttagcggcaagccctgcttttctgggggaggggcaagtaccccaacctcatatctctgcaccccgatcccttatttccgcgctctgacctcttatatctctgtgcccgatcccttatttccgcgctctgacctcttatatctctgtgccccgatcccttatttccacgctttgacctcttatatctctgtgccctgatcccttatttccgcgccccaacctcttatatctctgcaccccaatcccttatttccgtgccccaacctcttatatctctgtaccccaatcccttatttccacaccccgaccttgtatttctgtgccccaaacccttctctgcttttctggagggtaagaacccctgaaccccttccctccgtgtctctactctctcttttctctgggcttgcctccttcactatgggcaactttccaccctccatttctccttcttctcccttagcctgtgttcctaagaacttaaaacctcttcaactctcacctgacctaaaacctaagcatcttattttcttctgcaataccacttgaccccaatacaaactcgacagtagttccaaatagccagaaaatggcactttcaatttttccatcctgcaagatctaaataattcttgttgtaaaataggcaaatggtctgaggtgcctgacatcctggcattcttttacacatcggtccctccctagtgtctgtgcccagcacaactcatcccaaatcttccttctttctctcccgcctgtcccctcagtcccaaccccaagcgtcgctgagtctttctaatcttccttttctacagacccatctgacctctcccctcctccccaggctgctgctcgccaggctgagctaggtcccaattcttcctcagccttctctcctccgctctataatccttttaccacctccccttctcacacccagtctggcttacagtttcgttccgtgactagccctcccccacctgcccagcaatttactcttaaaaaggtggctggagctaaatgcatagtcaaggttaatgctcctttttctttatcccaaatcagatagcgtttaggctgtttttcatcaaatataaaaatctagcccagttcatgactcgtttggcagcaaccctgagacactttacagccctagatcctaaaatgtcaaaaggccgtcttattctcaaaatgcattttattatccaatctgctcccgacattacataaaacttcaaaaattaaattccagccctcaaaccccataagaggatttaattaactttgccttcaaggtgtacaataatagaaaaaagtcgcaattcttgcctccactgtgagacaaaccccagccacatctccagcacacaagaacttccaaacgcctgagctgcattggccaggccttcctccagaacctcctcccccaggagcttgctacaagtgccagaaatctggccaccaggccaaggaatgcctgcagcccaggattcctcctaagccgtgtcccatctgtgcaggaccccactggaaatcagactgtccaactcacctggcagccactcccagagcccctggaactctggcccaaggctctctgactccttcccagatcttcttggcttagcagctgaagactgatgctgcccaatcacctcggaagccccctagaccatcacggatgccgagctttgggtaactctcacagtggaaggtaagtccatccccttcttaatcaatacggaggctacccactccacattaccttcttttcaagtgcctgtttcccttgcctccataactgttgtgggtattgacggccaggcttccaaacctcttaaaactccccaactctggtgccaacttagaccatactcttttaagcactccttttaattatccccacctgcccagttcccttattaggctgagacactttaactaaattatctgcttccctgactattcctggattacagctacatctcattactgcccttcttcccaatccaaaacctcctttgtgtcctcctcttgtattccccaaccttaacccacaactataagatacctctactccctccttggtgaccgatcatgcaccccttaccatctcattaaagcctaatcacccttaccccgctcaatgccaatatcccatcccacagcatgctttgaaaggattaaagcctgttatcactcgcctgctacagcatggccttttaaagcgtataaactcttcttacaattcccccattttacctgtcctaaaaccagacaagccttacaagttagttcaagatctatgccttatcaaccaaattgttttgcctatccaccccatggtgccaaacccatatactctcctaccctcaatacctccctccacaatccattattctgttctggatctcaaacatgctttctttactattcctttgcacccgtcgtcccagcctctctttgctttcacttggactgaccctgacacccatgaggctcagcaaattacctgggctgtactgccacaaagcttcacagacggcccccattacttcagtcaagcctaaatttcttccttatctgttacctatctcagcataattctcataaaaacacatgtgctctccctgctgatcatgtctgattaatctcccaaacctcaatcccttataaaacaacaactcctttccttcctaggcatggttagtgtggtcagaattcttacgcaagagccaggactgcaccctgtagcctttcagtccaaacaacttgaccttactgttttagcctagccatcatgtctccgtgcagtggctgctgccgccctggtacttttagaggccctcaaaatcacaaactatgctcaacttactctctacatttctcatcacttccaaaatctattttcttcctcatacctgacacatatactttctgcttcccagctccttcagctgtactcactctttgttaagtcccacaattaccattgttcctggcccagacttcaatccggcctcccacattattcctgataccagacctgacccccatgaccgtatctctctgatccacctgacattcaccccatttccccatttttccttccttcctgttcctcaccctgatcacacttgatttattgatggcagttccaacaggcctaattgccacacaccagcaaaggcagactatgctatagaacaagccactagcctgccttttagaacctctcatttctttccatcgtggaaatctatcctcaaagaaataacttctcagtgttctatctgctattctactactcctcaggggttattcaggccccctcccttccctacacatcaagctcgaggatttgcccccacccaggactggcaaattagctttactcaataagccccgagtccgataactaaaatacctcttagtctaggtagacactttcactggataggtagaggcctttcctacagggtctgagaaggccaccgcagtcatttcttcccttctgtcagacataattcctcagtttagccttcccacctctatacagtctgataatagaccagactttattagtcaaatcagccaagcagtttttcaggctcttagtattcagtgaaaactttatatcccttacagtcctccatcttcaggaaaagtagaacagactaatggtcttttaaaaacacacctcaccaagctcagccaccaagttaaaaaggactggacaatacttttagcactttcccttcccagaagtcagacctgtcctcagaatgctacagggtacagcccatttgagctcctgtatagacgctccttttcattaggcccaagtctcattccagacaccagaccaacttagactatgccccccaaaaaacttttcatccctactgtcttctgtctagtcatactcctattcactgttctcaactactcatacatgccctgctcttgtttacactgccagtttacactgtttctccaagccatcacagctgatatctcctggtgctatccccaaacttccactcttaactcttgaagtaaataaataatctttgctggcaggactatgttgaatctccttaggcactctgtgatcagatgtcctgggtcctcccaattcttagaccttttatacctgtttttctccttctcttattccatttagtttttccattcatacaaaaccatatccaggccatcaccaataattctacatgacaaatgtttcttctaacaaccccacaatatcatcccttaccacaaaatcttccttcagcttaatctctcccactctaggttcccacgccacccctaatcccgcttgaagcagccctgagaagcatcgcccattatctctccataccatccccaaaaagttttcaccatcccaacactttaccactatttcattttatttttcttattaatataagaagacaggaatgtcagacctctgagcccaagctaagccatcatatcccctatgacctgcacatacacatccagatggctggttcctgccttaactgatgacattccactacaaaagaagtgaaaatggcctgttcctgccttaactgatgacattgtcttatgaaattccttctcctggctcatcctggctcaaaagctcccctactgagcaccttgtgacccctactctgcctgacagagaacaacccccatttgactgtaattttcctttatctacccaaatcttataaaatggccccactcctatctcccttcactgactctcttttcggactcagcccacctgcacccaggtgattaaaagctttattgctcacacaaagcctgtttggtggtctcttcacacggacgtgcatgaaa

SEQ ID NO: 411 - DNA, 705 bp, Homo sapiens
ttatagtaagtagtcaggcatgagcagggcaggagagagctccccgcaaccccccaccaggaaagtcaggcggctatcaagtgatggtcaggcagttgtcaaactgtctctctaaaataataattggttgcagctggtgccagggaaaggcagtctcccaacagatggaaacacctgaaactggcaatcagcagcttcccgataagacctcaggaactgggtgagcgggctcacgcatgcacactgagaggcaaaatggtggagttcaacaggtatgtcacctcctagggacgtttgaccggaaagggaagaacgcctaaagcgagcatgcggacaactccagtaacacattgcacatggtcacctcccatgtgccagcaggccactatgcatgcagacagccaccccaacgcaagaatcaaggcagaaggaatgtcaagaccccagaagtaagccaacgtgtaagatcccaagtcaaaaggtccaaatgcacacttctctttcaagtcgcctacttggcccttttccaagtgtacttgcctctttttttgttcctgctttaaagcttttcattaaactttcactcctgttctaaaacttgccttagtctctccttctgcccctcagccaaattctttcttctgaggaggcaagaattgaggttgcctcagcactgtatggattcctcgctggtaaaatactttg

SEQ ID NO: 412 - DNA, 940 bp, Homo sapiens
ttagagcaggtagttaggtagacatgaccagaacaggagaggactccctgtgaatgccaggtgaccatcaggtgatggccagtcagttgttaactgtctctctattaataaaataataattggtcatagctggtgccagggaaagacagtctcccaatagatagaaaacacctagcctgaccaacatggagaaaccctgtctctactaaaaatacaaaaaaaaattagctgggcatggtggcacatgcctgttatcccagctacttgggaggctgaggcaggagaattgcttgaacctgggaggcggaggttgtggtgagctgagattgtgccgttgcactccagcctgggcaacaaaagcgagactccacctcaaaaaaaaaaaaaaaagaaaaaaagaaaaggaaagaaaaagaaaacagatgaagctggtgaacagcagcttcccaataagatctcaggagttgggtgagcaggctcaagcattcatactaagaggcaaaatggcagcgtttaactggtatatgaccttcctgtgaaaatgctagaccaggtaagggaaaaatgcctcatggaggatgtgcacaactttagtaaacacactgtgtgtgcagcccctcccaagtcctggcaggccaccccacgtgtggacagccgctccaagggaaaaatcaaggggagagaaatggaaaccctggaaccatgccaatgtataaagccccatcttaagggccaagcagggcacttggatctctcaagttgcccgctaggccctcttccaagtgtactttgcttcctttcacccctgctatgaaacttttcactaaactctcactcctgttctaaaacttgccttggtctcttcctcagccttaaacctacttctgcccctcagctgaattctttcctccaaggaggcaaggattgagtttgctgtaga

SEQ ID NO: 413 - DNA, 5873 bp, Homo sapiens
gtcaggcctctgagcccaagccaagccatcgcatcccctgtgacttgcatgtatatgcccagatggcctgaagtaactgaagaatcacaaaagaagtgaaaaggccctgccccgccttatctgatgacattccaccattgtgatttgttcttgccccaccttaactgagtgattaaccctgtgaatttccttttcctggctcagaagctcccccactgagcaccttgtgacccccgcccctgcccaccagagaacaaccccctttgactgtaattttccattaccttcccaaatcctacaaaacggccccacccctatctccctttgctgactctcttttcggactcagcccacctgcacccaggtgaaataaacaaccatgttgctcacacaaagcctgtttggtggtctcttcacatggacgcgcatgaaatttggtgccatgactcggatcgggggacctcccttgggagatcaatcccctgtcctcctgttctttgctccgtgagaaagatccacctacaacctcaggtcctcagaccgaccagcccaaggaacatctcaccaattttaaatcaggtaagcggtctcttcttactctcttctccaacctctctcactgtccctcaaccactttctcctttccactcttcaatctctcccttctcttaatttcaattcctttcattttctgggagagacaaaggagacatgttttatccgtggacccaaaactccggcgccggtcacagactgggaaggcagctttcccttggtgtttaatcattgcagggacgcctctctgattattcacccacgtttcaaaggtgtcagaccacgcagggacgcctgtcttggtccttcacccttagcggcaagtcccgcttttctggggaaggggcaagtaccccaaccccttctctccttgtctctaccccttctctgcttttctggggaaggggcaagtaccccaacccttctctccttgtctctaccccttctctgcttttccgggggtggggcaagtaccccaaccccttctctccttctctccaccccttctctgctttcctggggcaggggcaagtaccactcaaccccttctccttcacccttagcggtaagtcccgctttcctagggggcaagaaccccccaatcgcttatttccatgccccaacctcttatctctgcgccccaatcgcttatttccatgccccaacctcttatctctgtgccccaattgcttatttccgcgccccaacctgttatctctgtgccccaatcccttacttccatgccccaacctcttatgtctgcaccccaatcccttatttccatgctccgaccctttctctgcttttctggtgggcaagaaacccccaccccttctccatgtctctactcttttctctgggcttgcctccttcactatgggcaagcttccaccttccattcctccttcttcttccttagcctgtattcttaagaacttaaaacctcttcaattctcacctgacctaaaatctaagcatctcattttcttctgcaatgccgcttgaccccaatacaaactggacagtagttccaaatagccagaaaacggcactttcaatttttccatcctataagatctaaataattcttgtcgtaaaatgggcaaatggtctgaggtgcctgacgtccaggcattcttttacacatcagtcccttcctagtctctgtgcccagtgcaactcgtcccaaatctcccgcctgtcccctcagtcccaaccccaagcgtcgctgagtctttctaatcttccttttctacagacccatctgacctctcccctccttgccaggccaagctaggtcccaattcttcctcagcctccgctcctccaccctgtaatctttttattgcctcccctcctcacacctggtccggcttacagtttcgttccgtgactagcccttccccacctgcctagcaatttactcttaaaaaggtggctggagctaaaggcatagtcaaggttaatgctcctttttctttatcccaaatcagatagcgtttaggctctttttcatcaagtataaaaatccagcccagttcatggctcgtttgacagcaaccctgagacgctttatagccctagaccctaaaaggtcaaaaggccatcttattctcaatatacattttattacccaatctgctcccgacattaaataaaactccagaaattggaatctggccctcaaaccccacaacaggacttaattaacctcaccttcaaggtgtgcaataacagaaaaaagttgcaattccttgcctccactgtgagacaaaccccagccacatctccagcacacaagaacttccaaacgcctgaaccatagcaaccaggcgttcctccagaacctcctcccccaggcgcttgctacacgtgccggaaatctggccactgggccaaggaatgcccgcagcctgggattcctcctaagccgcgtcccatctgtgtgggaccccactgaaaatcggactgttcaactcacctggcagccactcccagagcccaaggaactctgggcccaaggctctctgactgactccttcttggcttaccggctgaagactgacgctgcctgatcacctcagaagccccgtagaccatcacggacgccgagctttaggtaactctcacggtggagggtaagtccatccccttcttaatcaatacggaggctacccactccacattaccttcttttcaagggcctgtttcccttgcctccataactgttgtgggtattgacagccaggcttctaaacctcttaaaactccccaactctggcgccaacttagacactactcttttaagcactcctttttagttatccccacctgcccagttcccttattaggctgaggcactttaagtaaattatctgcttccctgactattcctggactacagctatatctcattgccgcccttcttcccaatccaaagcctcctttgcgtcctcctcttgtatccccccaccttaacccacaagtataagacacctctactccctccttggcgactgatcatgcaccccttaccatctcattaaaacctaatcacccttaccccactcaacgccaatatcccatcccacagcacgctttaaaaggattaaagcctgttatcactcgcctgctacagcatggccttttaaagcctataaactctccttacaattcccccattttacctgtcctaaaaccagacaagacttacaagttagttcaggatctgtgccttatcaaccaaattgttttgcctatcccccttgtggtgcccaacccgaacactcttttgtcctcaataccttcctccacaactcactattccgtgcttgatcgtaaagatgcttttttcactgttcccctgcacccctcgtccccgcctctctttgctttcacttagactgaccctgacacccatcaggctcagcaaattacctgggctgtcctgccgcaaggcttcacagacagcccccattacctcagtcaagcccaaatttcatcctcatctgttacctatctcggtataattctcacaaaaacacacgtgctttccctgctgatcatgtctgattaatctcccaaacctcaatcccttacaaaacaacaactcctttccttcctaggcatggttagtgtggtcagaattcttacacaagagccaggaccgcaccctgtagcctttctgtccaaacaacttgaccttactgttttagcctagccctcatgtctgtgtgcagcggctgccgctgctttaatacttttagaggccctgaaaatcacaaactatgctcaactcactctctacatttctcaacttccaaaatctattttcttcctcatacctgacgcatacactttctgctccccggctccttcagctgtactcactctttgttaagtcccacaattaccactgttcctggcccggacttcaatctggcctcccacattattcctgataccacacctgacccccatgactgtatctctctgatccacctgctattcaccccatttccctgtatttccttctttcctattcctcaccctgatcacgcttgatttattgatggcagttccaccaggcctaatcgccacataccagcaaatgcaggctatgctatagtacaagccactagcctgcctctcagaacctctcatttcctttccatcgtggaaatctatcctcaagaaaataacttctcagtgttccatctgctattctactactcctcagggattattcaggccccctcccttccctacacatcaagctcgagaatttgcccccacccaggactggcaaattagctttactcaacatgcccgagtcaggaaactaaaatacctcttagtctaaatagacactttcactgaataagtaaaggcctttcctacagggtctgagaaggccaccacagtcatttcttcccttctgtcagacataattcctcagtttagccttcccacctctatacagtctgatagcagaccagcctttattagtcaaatcagccaattagtttttcaggctcttagtattcagtgaaacctttatatcccttacggtcctccgtcttcaagaaaagtagaacggactaaaggtcttttaaaaacacacctcaccaagctcagccaccaacttaaaaaggactggacaatacttttaccactttcacttctcagaattcaggcctgtcctcagaatgctacaaggtacagcccatttaagctcctgtatagatgctcctttttattaggccccagtctcattccagacactggaccaacttagactgtgcccccaagaaaacttgtcatccctactattttctgtctagtcatattcctattctccattctcaactactcacacatgccctgctcttgttcacactgccagtttacactgtttctccaagccatcacagctgatatctcctcgtgctatccccaaactgccactcttaactcttgaagtaaataaataatctttgctggcaggactatgctgaatctccttaggcactctctaatcagatgtcctaggtcctcccaattcttagaccttttatacctgtttttctccttcttattccatttagtttttcaattcacacaaaactgtatccaggccatcaccaatcatactatatgacaaatgtttcttctaacaaccccacaatatcaccccttaccacaagatctcctttcagcttaatctctcccactctaggttcccacccgcccctaatcccgcttgaagcagccctgagaaacatcgcccattctctctccataccaccccccaaaaattttcgccaccccaacacttcaacactattttgttttatttttcttattaatataagaaggcaggaatgtcagtcctctgagcccaagccaagccatcgcatcccctgtgacttgcacgtatacgcccagatggcctgaagttactgaagaatcacaaaagaagtgaaaaggccctgccccgccttaactgatgacattccaccattgtgatttgttcctgccccaccttaactgagtgattaaccctgtgaatttccttctcctggctcagaagctcccccactgagcaccttgtgacccccgcccctgcccaccagagaacaaccccctttgactgtaattttccattaccttcccaaatcctataaaatggccccatccctatctccctttgctgactctcttttcggactcagcccacctgcacccaggtgaaataaacaaccatgttgctcacacaaagcctgtttggtggtctcttcacacggacacgtatgaaa

SEQ ID NO: 414 - DNA, 606 bp, Homo sapiens
ttacagtaggtagctagtcagacacaaacaggacagaagagggtccccacaccccaccgggaaagtcaggcgaccatcgggtgatggtcaggccattgttaactgtctctctaaaataataattggttgcagccagctccagggaaaggcagtctccctatagatagaagaaacctgaaactggtgatcatcagcttcctgataagatcccaggagttgggcgtgcggactcacacatgagcaccaagaggcaaaatggcggagtttaactggtatttgatcttctgggggcatgtcaccagtaaagggaagaatgtttcaagtgagcataagtacaactccagtaaacacactgcgcatgctcacctcccaagtgctagcaggtcactacacatatggacaaaccaccctcaacgaaagaatcaggggagaagaccccagaagtatgccaacatataaaaccctaagtcaaaccacacttgtccttcaagtcgcccacttggacctcttctaagtgtcctttccttccaatcctgctctaaagctttttaataaactttcactcctgctctaaaacttgcctgggtctctccctctgccttatgc

SEQ ID NO: 415 - DNA, 6501 bp, Homo sapiens
gtggggaaaagcaagagagatcagattgttactgtgtctgtgtagaaagaagtagacataggagactccattttgttatgtactaagaaaaattcttctgccttgagattctgttaatctataaccttacccccaaccctgtgctctctgaaacatgtgctctgtcaactcagagttaaatggattaagggcggtgcaagatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtataagaagaaggcatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcattgaaatgtttatgtgtatgcatatctaaaagcacagcacttaatcctttaccttgtctatgatgcaaagacctttgttcacgtgtttgtctgctgaccctctccccacaattgtcttgtgaccctgacacatccccctcttcgagaaacacccacagatgatcaataaatactaagggaactcagaggctggcgggatcctccatatgctgaacgctggttccccgggtccccttctttctttctctatactttgtctctgtgtctttttcttttccaaatctctcgttccaccttacgagaaacacccacaggtgtgtaggggcaacccacccctacatctggcgcccaacgtggggcttttctctagggtgaaggtacgctcgagcgtggtcattgaggacaagtcgacgagagatcccgagtacttctacagtcagccttacggtaagcttgtgcactcggaagaagctagggtgataatggggcaaactaaaagtaaagttaaaagtaaatatgcctcttatctcagctttattaaaattcttttaaaaagagggggagttaaagtatctacaaaaaatctaatcaagctatttcaaataatagaacaattttgcccatggtttccagaacaagaaactttagatctaaaagattggaaaagaattggtaaggaactaaaacaagcaggtaggaagggtaatatcattccacttacagtatggaatgattgggccattattaaagcagctttagaaccatttcaaacagaagatagcgtttcagtttctgatgccactggaagctgtataatagattgtaatgaaaagacaaggaaaaaatcccagaaagaaaccgaaagtttacattgcgaatatgtagcagagccggtaatgactcagtcaacgcaaaatgttgactataatcaattacaggaggtgatatatcctgaaacgttaaaattagaaggaaaaggtccagaattagtggggccatcagagtctaaaccacgaggcacaagtcctcttccagcaggtcaggtgcctgtaacattacaacctcaaacgcaggttaaagaaaataagacccaaccgccagtagcctatcaatactggccaccggctgaacttcagtatcggccacccccagaaagtcagtatggatatccaggaatgcccccagcaccacagggcagggcgccataccctcagccgcccactaggagacttaatcctacggcaccacctagtagacagggtagtgaattacatgaaattattgataaatcaagaaaggaaggagatactgaggcatggcaattcccagtaacgttagaaccgatgccacctggagaaggagcccaagagggagagcctctcacagttgaggccagatacaagtctttttcgataaaaatgctaaaagatatgaaagagggagtaaaacagtatggacccaactccccttatatgaggacattattagattccattgctcatggacatagactcattccttatgattgggagattctggcaaaatcgtctctctcaccctctcaatttttacaatttaagacttggtggattgatggggtacaagaacaggtccgaagaaatagggctgccaatcctccagttaacatagatgcagatcaactattaggaataggtcaaaattggagtactattagtcaacaagcattaatgcaaaatgaggccattgagcaagttagagctatctgccttagagcctgggaaaaaatccaagacccaggaagtacctgcccctcatttaatacagtaagacaaggttcgaaagagccctaccctgattttgtggcaaggctccaagatgttgctcaaaagtcaattgccgatgaaaaagcccgtaaggtcatagtggagttgatggcatatgaaaacgccaatcctgagtgtcaatcagccattaagccattaaaaggaaaggttcctgcaggatcagatgtaatctcagaatatgtaaaagcctgtgatggaatcggaggagctatgcataaagctatgcttatggctcaagcaataacaggagttgttttaggaggacaagttagaacatttggaggaaaatgttataattgtggtcaaattggtcacttaaaaaagaattgcccagtcttaaataaacagaatataactattcaagctactaccacaacaggtagagagccacctgacttatgtccaagatgtaaaaaaggaaaacattgggctagtcaatgtcgttctaaatttgataaaaatgggcaaccattgtcgggaaacgagcaaaggggccagcctcaggccccacaacaaactggggcattcccaattcagccatttgttcctcagggttttcagggacaaaaaccccccctccctgtcccaagtgtttcagggaataagccagttaccacaatacaacaattgtcccccgccacaagcggcagtgcagcagtagatttatgtactatacaagcagtctctctgcttccaggggagcccccacaaaaaatccccacaggggtatatggccccctgcctgaggggactgtaggactaatcttgggaaaatcaagtctaaatctaaaaggagttcaaattcatactggtgtggttgattcagactataaaggcgaaattcagttggttattagctcttcaattccttggagtgccagtccaggagacaggattgctcaattattactcctgccatatattaagggtggaaatagtgagataaaaagaacaggagggtttggaagcactgatccaacaggaaaggctgcatattgggcaagtcaggtctcagagaacagacctgtgtgtaaggccattattcaaggaaaacagtttgaagggttagtagacactggagcagatgtctctatcattgctttaaatcagtggccaaaaaattggcctaaacaaaaggctgttacaggacttgtcggcataggcacagcctcagaagtgtatcaaagtacggagattttatattgcttagggccagataatcaagaaagtactgttcagccaatgattacttcaattcctcttaatctgtggggtcgagatttattacaacaatggggtgcggaaatcatgcccgctccattatatagccccacgagtcaaaaaatcatgaccaagatgggatatataccaggaaagggactagggaaaaatgaagatggcattaaagttccagttgaggctaaaataaatcaagaaagagaaggaatagggtatcctttttaggggcggccactgtagagcctcctaaacccataccattaacttggaaaacagaaaaaccggtgtgggtaaatcagtggccgctaccaaaacaaaaactggaggctttacatttattagcaaatgaacagttagaaaagggtcatattgagccttcattctcgccttggaattctcctgtgtttgtaattcagaagaaatcaggcaaatggcgtatgttaactgacttaagggccgtaaacgccgtaattcaacccatggggcctctccaacccgggttgccctctccggccatgatcccaaaagattggcctttaattataattgatctaaaggattgcttttttaccatccctctggcagagcaggattgtgaaaaatttgcctttactataccagccataaataataaagaaccagccaccaggtttcagtggaaagtgttacctcagggaatgcttaatagtccaactatttgtcagacttttgtaggtcgagctcttcaaccagttagagaaaagttttcagactgttatattattcattatattgatgatattttatgtgctgcagaaacgaaagataaattaattgactgttatacatttctgcaagcagaggttgccaatgctggactggcaatagcatctgataagatccaaacctctactccttttcattatttagggatgcagatagaaaatagaaaaattaagccacaaaaaatagaaataagaaaagacacattaaaaacactaaatgattttcaaaaattactaggagatattaattggattcggccaactctaggcattcctacttatgccatgtcaaatttgttctctatattaagaggagactcagacttaaatagtaaaagaatattaaccccagaggcaacaaaagaaattaaattagtggaagaaaaaattcagtcagcgcaaataaatagaatagatcccttagccccactccaacttttgatttttgccactgcacattctccaacaggcatcattattcaaaatactgatcttgtggagtggtcattccttcctcacagtacagttaagacttttacattgtacttggatcaaatagctacattaatcggtcagacaagattacgaataataaaattatgtggaaatgacccagacaaaatagttgtccctttaaccaaggaacaagttagacaagcctttatcaattctggtgcatggcagattggtcttgctaattttgtgggaattattgataatcattacccaaaaacaaagatcttccagttcttaaaaatgactacttggattctacctaaaattaccagacgtgaacctttagaaaatgctctaacagtatttactgatggttccagcaatggaaaagcagcttacacagggccgaaagaacgagtaatcaaaactccatatcaatctgctcaaagagcagagttggttgcagtcattacagtgttacaagattttgaccaacctatcaatattatatcagattctgcctatgtagtacaggctacaagggatgttgagacagctctaattaaatatagcatggatgatcagttaaaccagctattcaatttattacaacaaactgtaagaaaaagaaatttcccattttatattactcatattcgagcacacactaatttaccagggcctttgactaaagcaaatgaagaagctgacttactggtatcatctgcactcataaaagcacaagaacttcatgctttgactcatgtaaatgcagcaggattaaaaaacaaatttgatgtcacatggaaacaggcaaaagatattgtacaacattgcacccagtgtcaagtcttacacctgcccactcaagaggcaggagttaatcccagaggtctgtgtcctaatgcattatggcaaatggatgtcacgcatgtaccttcatttggaagattatcgtatgttcatgtaacagttgatacttattcacatttcatatgggcaacttgccaaacaggagaaagtacttcccatgttaaaaaacatttattgtcttgttttgctgtaatgggagttccagaaaaaatcaaaactgacaatggaccaggatattgtagtaaagctttccaaaaattcttaagtcagtggaaaatttcacatacaacaggaattccttataattcccaaggacaggccatagttgaaagaactaatagaacactcaaaactcaattagttaaacaaaaagaagggggagacagtaaggagtgtaccactcctcagatgcaacttaatctagcactctatactttaaattttttaaacatttatagaaatcagactactacttctgcagaacaacatcttactggtaaaaagaacagcccacatgaaggaaaactaatttggtggaaagataataaaaataagacatgggaaatagggaaggtgataacgtgggggagaggttttgcttgtgtttcaccaggagaaaatcagcttcctgtttggatacccactagacatttgaagttctacaatgaacccatcggagatgcaaagaaaagggcctccacggagatggtaacacc

SEQ ID NO: 416 - DNA, 755 bp, Homo sapiens
gagagacaggactagctggatttcctaggccaactaagaatccctaagcctagctgggaaggtgaccgcatccaccgttaaacaccggcttgcaacttagcccatacccgaccaatcaggtagtaaagagagctcacttaaatgctaattaggcaaaaacgggaggtaaagaaatagtcaatcatctatcgcctgagagcacagggggaggacaatgatcaggatataaacccaggcattccagccagcaacggctacctgctttgggtcccctccctttgtatgggagctgtgttttcactctgttaaatcttgcaactgcactctcttctgatccgtgtttgttatggctagagctgagctttcgctcaccgtccaccactgctgtttgccgccgtagcagaccgccgctgaattccacccctctggatccggtagggtgcccactgtgctcctgatccagcgaggcacccattgctgctccaatcgggctaaaggcttgccattgttcctgcagggctaagtgcctgggttcgtcctaatcgagctgaacactagtcactgggttccacagttctcttctgtgtcacagcttctaatagagctataacactcaccgcatggcccaagattccattccttggaatctgtgaggccaaaaaccccaggtcagagaataaaagtcttgccgccatcttggaagcagcccaccaccatcttgggagctctgggagcaaggaccccggggtaacatt

SEQ ID NO: 417 - DNA, 392 bp, Homo sapiens
gtcaggcctctgagcccaagctaagccaccgtatcccctgtgacctgcacgtatatacgcccagatggcctgaagcaagtgaagaatcacaaaagaagtgaaaatggcctgttcctgccttaactgatgacattatcttgtgaaattccttctcttggctcatgctggctggaaaagctcccccactgagcaccttgtgacccccacccctgcccgccagagaacaaccccctttgactgtaattttcctttacccacccaaatcctataaaacggccccacccctatctcccttcgctggctctgtttttggactcagcccgcctgcgcccaggtgattaaaaagctttattgctgacacaaagcctgtttggtggtctcttcacatggac

SEQ ID NO: 418 - DNA, 477 bp, Homo sapiens
tcaggtggttggtaactgtctctcttaaaataataattggttgcaatcaacaccagggaaaggccgtttcccaatagatagaaagcacctggaactggtgatcagcagcttcccgataagatctcaggagctgggcgagtgggctcaagcatgtgcactaagaggcaacatggtggagtttaactggcatatgacctgggagcatttgactggtaaaggaagaatgcctcaagtgagcatgcgcacttcagtaaacacgctgcgcatgaggcccctccggagcgctggcaggccactgcgcatgcggacagaccaccccaagggaagaaccaggggaaagttaacgcaagccccggaaggatgccaacctatcaaaccccaagtccaagatcaaacagtgcacttgactctctcaagtcacctgcttgaccctcttccaagtgtactttacctcctttccttactgccctaaaactt

SEQ ID NO: 419 - DNA, 7578 bp, Homo sapiens
gtcaggcctctgagcccaagtgaagccatcatatcccctgtggcctgcacgtacacatccagatggccggttcctgccttaactgatgacattccaccacaaaagaagtgaaaatggcctgttcctgccttaactgatgacattgtcttgtgaaattccttctcctggctcatcctggctcaaaatctcccctactgagcaccttgtaacccccgactctgcccaccagagaacccccatttgactgtaattttccattaccttcccaaatcttataaaacggccccacccctatctccctttgctgactctcttttcggactcagcctacctgcacccaggtgaaataaacagccttgttgctcacacaaagtctgtttaatggtctcttcacatggacacacatgaaatttggtgccgtgactcggattgggggacctcccttgggagatcaatcccctgtcctcctgctctttgtttcatgaggaagatccacctacgacctctggtcctcagaccaaccagcccaaggaacatctcaccaattttaaatccagtaagcggcctctttttactctcttctccaacctctctcactatccctcaacctctttctcctttcaatcttggcgccacacttcaatctctcccttctcttaatttcaattcctttcattttctggtagagacaaaggagacacgttttatctgtggactcaaaactccggcgctggtcacggactcgggaaggcagccttcccttggtgtttattcattgcagggacgcttctctgattattcatccatgtttcagaggtgtctgaccactcagggatgcctgccttcgtccttcacccttagcagcaagtcccacttttctgggggaggggcaaaaacttgactgcttctctccctgtctctaccccttctctgcttttctggggggcaagaaccccccggtcccttatttctgcaccccgacctcttatctctgcaccccgatcccttattcccattccccaacctcatatctctgtgccccaaccccttatttccgtgccccaagccctttcctgcttttctggagggtaagaacccccgaaccccttccctccatgtctctactctctcttttctctgggcttgcctccttcactatgggcaatcttccaccctccattcctccttcttctcccttagcctgtgttcttaaaaacctaaaacctcttcaactcacacctgacctaaaacctaaatgccttattttcttctgcaatgccgcttgaccccgatacaaacttgacagtggttccaaatagccagaaaactgcactttcattttttccatcctacaagatctaaataattcttgtcataaaatgggcaaacagtctgaggtgcctgacgtccaggcattctttcatacatcagtccctccctagtctctgttcccaatgcaactggtcccaaatcttccttctttccctcccgcctgtcccctcagacccaaccccaagcatcactgagtctttctaatcttccttttctacagacccatctgacctctcccttcctccccaggccgagctaggtcccaattcttcctcagcctctgctcctccaccctataatccttttatcacctcccctcctcacacctggtctggcttacagtttcattccgtgagtagccctccttttaaactgcccagcaatttcctcttaaaaaggtggctggagctaaaggcatagtcaaggttaatgctcctttttctttatcccaaatcagatagcatttaggctttttttcatcaaatataaaaacccagctcagttcatggctcgtttggcagcaaccctgggatgctttacagccctagaacctaaaaggtcaaaaggccgtcttattctcaatatacgttttattacccaatctgctcccaacattaaataaaactccaaaaattaaattctggccctcaaaccccacaacaggacttaattaacctcgccttcaaggtgtacaataatagagtagaggcagccaagtagcaacatatttctgagttgcaattctttgcctccactgtgagacaaaccccagccacatctccagcacacaagaacttccaaacacctgaaccgcagcggccaggcattcctccaggcccgccttccccaggagcttgctacaagtgccagaaatctggccaccaggccaaggaatgcctgcagcctgggattcctcctaagccacgtcccatctgtgtgggaccccactgaaaatcagactgttcaactcacctggcagccactcccagagcccctggaactctggcccaaggctctctgactgactccttcccagatcttctcggcttagcggctgaagactgacgctgcccgatcacctcggaagccccctagaccatcaaggacgccgagcttcgggtaactctcacattggagagtaaatccgtccccttcttaatcaatatggaggctacacactccacattaccttcttttcaagggcctgtttcccttgcctccataactgttgtggattgacagccaggcttctaaacctcttaaaactccccaactctgctgccaacttagacaatactcttttaagcactcctttttcgttatccccacctgcccagttcccttattaggccgagacactttaactaaattatctgcttccctgactattcctgggctacagccacagctcattgccaccttttcccccagttcaaagcctccttcacatccttcccttgtatcctcccaccttaacccacaagtatgggatacctctactccctccttggcgaccgaacatgcaccccttaccatctcattaaaacctaatcacccttaccccactcaatgccaatatcccatcccgcagcatgctttaaaaagattaaagcctgttatcactcacctgctacagcatggccttttaaagcctataaactctccttacaatttcccccattttacctgtcctagaaccagacaagccttacaggttagttcaggatctgagccttatcaaccaaattgttttgcctatacaccccttggtgccaaacccatatactctcctatcctcaatacctccctccacaacccattattctgttctggatctcaaacatgctttctttactatcccttttcaccgttcatcccatcctctcttagctttcacttagactgaccctgacacccatcaggctcagcaaattacctgggctgtactgccacaagccttcacagacagcccccactacttcagtcaaacctaaatttcatcctcatctgttacctatcttggcataattctcataaaaacacacgtgctctccctactgatcgtgtctgactaatctcccaaacctcaatcccttctacaaaacaacaacttctttccttcccaggcatggttagatacttttgactttagatatctggttttgccatcctaacaaaaccattatataaactcacaaaaggaaacctagctgaacccatagatcctaaatcctttccccactcctctttccattccttgaagacagctttagagactgccccaccctagctctccctgactgatcccaacccttttcattacccacagctgaagtgcagggctgtgcagtcagaattcttacacaaggaccaggaccgcaccctgtagcctttttatccaaacaacttgaccttactgttttgcctagccctcaagtctgcatgtggcggctgccactgcattaatactttagaggcccttaaaatcacaaactatgctcaactcactctctacaattctcataacttccaaaatctattttcttcctcacacctgacacatatacgttctgcttcccggctccttcagctgtactcactctttgttgagtctcccacaattaccattgttcctggcccgacttcaatctggcctcccacattattcctgataccacacctgacccccatgactgtatctctctgatccacctgacattcactccatttccccatattctttcatgttcctcatcctgaacacacttggtttattgatggcagttccaccaggcctaatcgccactcaccagcaaaggcaggctatgctacagtatcttccacatctatcattgaggctactgctctgcccccctccactacctctcagcaagccgaactcattgccttaaggcaagccctcactcttgcaaaaggactaaaggtcaatatttatactgactctaaatatgccttccatatcctgcaccaccatgcaagaggtttcctcatcacacaagggtcctccatcattaatgcctctttaataaaaacgcttctcaaagctgctttacttccaaaggaagctggagtcattcactgcaaaggccatcaaagggcatcagaccccatcgctcaggacaatgcttatgctgataagatagctaaaaaagcagctagcgttccaacttatatccctcactttcagtttttctccttctcatctggcctctcccacctactcccccgctgaaacttccacctatcaatctcttcccacacaaggcaaatggttcttagaccaaggaaaatatctccttcaagcctcacaggcccattctattctatcgtcatttcataacctcttccacgtaggttacaagccactagcctgtctcttagaacctctcatttcctttccatcatggaaatctatcttcaaggaaatcacttctcagtgttccatttgctattctactacccctcagggattgttcaggccccctccctttcccacacatcaagctccgggatttgcccccacccaggactggcaaattggctttactcaacatgccctgagtcaggaaactaaaatacctcttagtctaggtagacactttcactggatgggtagaggcctttcctacagggtctgagaaagccactgcggtcatttcttcccttctgtcagacataattactcggtttggccttcccacctctacgcagtccgatagtggacaggcctttattagtcaaatcagccaagcagtttttcaggctcttggtattcagtgaaacctttatatcccttacggtcctcagtcttcaggaaaggtagaacggactaatggtcttttaaaaacacgcctcaccaagctcagccaccaacttaaaaaggactggacaatacttttacctctttcttttctcagaattcaggcctgtcctcggaatgctacagggtagagcccatttgagctcctgtatggacgctcctttttattaggccccagtctcattccagacaccagaccaacttggactgtgctccccaaaaaacttgtcatccctactatcttctgtctagtcatactcctattcaccattctcaactactcatacatgccctgctcttgtttacactgccagtttacactgtttctccaagtcatcacagctgatatctcctggtgctacccccaaactgccactcttaactctgaaataaataatctttgctggcagggctatgctgaacctccttaggcactctctaattagatgtcctgggtcctcccaattcttagacctttaatacctgtttttctcctcttattccatttagtttttcaattcatacaaaaccatatccaggccatcaccaataattctaaatgacaaatgtttctgctaacaaccccacaatatcaccccttaccacaaaatcttccttcagcttaatctctcccactctaggttcccacgtcgtccctaatcctgctcgaagcagccctgaggaacatcgcccattatctctccataccatcccccaaaatttttgccatcccaacactttaccactgtttcattttatctttcttattaatataagaagacaagaatgtcaggcctctgagcccaagctaagccatcatatcccctgtgacctgcacatacacatccagatggctggttcctgccttaactgatgacattccaccacaaaagaagtgaaaatggcctgttcctaccttaacagatgacattgtcttgtgaaattccttctcctggctcatcctggctcaaaagctcccctactgagcaccttgtgactcccactcttcccaccagagaacaacccccgtttgactgtaattttcctttacctacccaaatcctataaaacggccccacccctatctgccttcgctgactctgttttcggactcagcctgcctgcacccaggtgaaataaacagccttgttgctcacacaaagcctgtttggtggtctcttcacacggacgcacatgaaattcacctgtgcaagctcccagctttcaggctgctctttgttagaaaatgatttggggctgcttttcattaaaaagaaaagccttactgaggactcccatacccttgctaactgcctaagtgatttattcttaactcttatatcaatatcaccatcaaaagtcatgcattgacaaatgtacccacttttgaccaaggttttgtggcattgttggaaattgtattcctagagtagatataggatttttacaaaatgtaattaatggggatgagatttattgggaaactgttaaaatacttttgacttatttagaaaacatcttcctttaatttcctgcagtaataaggtacttgccctttttctagttggactcttagatacacaataaaaatagatatattgtgatctttctttctatgactgatagatacctttttataagttcactctttagtcaagttctggaatttcacaccattgataagaatttggcccattctgaagctgctgaagctgtgcttatcttgaaggttaattagattgtttgaattccaaaaagaaggtaggggatggtaaattcagtctcagtccttaggtagctttcagtcaccataatcgagaagatcaatgaaaatttttaatcaatgaaagtcagaaatatatattgtggtatccaaaacatgaaacacagcactgaactcttcactaatataaatcagtgaatgagggcaaggtcaaaaggtacattctaaagggacatgttttgtgtcaggcctctgagcccaagctaagccatcatatcccctgtgacctgcacgtatgggtccagatggcccaaagcaagtgaagaatcacaaaagaagtgaaaatggtcagttcctgccttaaccgatgacattccaccacaaaagaagtgaaaaatggcctgttcctgccttaactgatgaccttaccttgtgaaattcctactcatggctcagaagctcccccactgagcaccttgtgacccccacccctgcaggccagagaactaccctctttcacagtaattgtccattacctacccaaatcctataaaatggccccagccctatttcccttagctgactatttttggactcagctcgcctgcacccaggtaattagaaagctttattgctcacacaaagcctgtttggtggtctcttcacacggaggcgcgtgaaa

SEQ ID NO: 420 - DNA, 2376 bp, Homo sapiens
acaacttgaccttactgttttaggctggccatcatgtccccgtgcagcagctgccgctgccctaacacttttagaggccctcaaaatcacaaactatgctcaactcactctctatagttctcataacttccaaaatctattttcttcctcacacctgatgcatatactttctgctccccggctccttcagctgtactcactctttgttgagtctcccacagttaccattgttcctggcccggacttcaatccagcctcccacactattccggatacatctgactcccatgactgtatctctctgatccacatgacattcactccctttctccatgtttccttctttcctgttcctcaccctgatcacacttggtttattgatggcagttccaccaggcctaatcgccactcaccagcaaaggcaggctatgctatagtatcttccacatctatcactgaggctaccgctctgcccccctccattacctctcagcaagctgaactcactgccttaacttgagccctcactcttgcaaagggactacccatcaatatttatactgactctaaatatgccttccatatcctgcaccaccatgctgttatataggcagaaagaagtttcctcactatgcaagagtcctccatcaataatgcctctttaataagaactcttctcaaggctgctttacttccaaagaaagccggagtcattcactgcaaaggccatcaaaaggcttcagatcccattgctctggacaacgcctatgctgataagatagctaaaaaagcagctagcgttccaacttctatccctcagggcagttttcctccttctcatctggccactcccacctactccctcgctgaaacttccacccatctcttcccacacaaagcaaatggttcttggaccaaagaaaaatctccttccagtctcacaggcccattctattcgtcatttcataacctcttccatgtaggttgcaagccgctagcccgcctcttagaacccgctagcccacctcttagaacctctcatttcctttccatcgcaaaaatctatcctcaaggaaatcacttttcagtgttccatctgctattctactactcctcaagaatttctcaggccccctcccttccccacacatcaagctcggggatttgccccgcccaggactggcaaattgactttactcacatgcctcgagtcaggaaactaaaatacctcttggtctgggtagacactttcactggatgggtagaggcctttcccacagggtctaagaaggccaccgtggtcatttattcccttctgtcagacatagttcctcggtttggccttctcacctctatacagtccgataacggaccggcctttactagtcaaatcacccaagcagtttctcaggctgttggtattcagtggcacctggtttttcctcaaactgccacccttaagtctctctttaagtggatagaagatcttcagtggcaaggtaccctccaatactttcaccctgatgaagtcctattctttacttttatacttactcttattctcattcccgttcttatgccaccctctacctctccccagctatctctatcacactatcaatctcagttactctctcctagccgtttctaatccttctttaacaaacaattgctggctttgcatttctctttcttccaaaatcacaaaggtctcgacttactgctaaaaaaaaaaaaaaggggactctatatttttaaatgaagagtgctatttttacctaaatcaatctggcctggtatatgacaacattaaaaaaaactcaaagatagagcctaaaagcttgccaaccaagcaagtaattacactaaccccccttggacactctaattagatgtcctgggtcctcccaattcttagtccttttatacctgtttttctccttctcttattcagaccttgtgtcttccatttagtttctcaattcatccaaaaccatatccaggccatcaccaatcattctatacgacaaatgtttcttctaacaacccgacaattatcaccccttaccacaaaatcttccttcagcttcatctctcccacactaggtttccatgttgccccagtcctgctcaaagcagccctgagaaacattgcccattatctctccataccaccccccaaaattttccccaccccaacactttaccactattttatttttcttattaatataagaagacaggaatgtcaggcctctgagcccaagctaagccatcatatccccagtgacctgcacgtatacatccagatggcctgaagcaactgaagatacacaaaagaagtgaaaatagccttaactgataacattccaccat

SEQ ID NO: 421 - DNA, 65 bp, Homo sapiens
ggtagataggcatgggcagggcaggagagggctctccccgccacccaccagaaatgtcaggtgac

SEQ ID NO: 422 - DNA, 686 bp, Homo sapiens
tagagtaggtagctaggcagacatgagtaggactggagacagaccccccaccctccaccaggaatgtcaggcagccaccaggtgatagtcaggcagttgttaaactgtctctctaaaataataactggttgcagccagcaccaggagaaggtagtttcccaacagatagaaaacacctgaagctggtgattagcagcttcccagtaagatctcaggaattgggcaggtgggctcaagcatgtgcactaagaggcaaaatggtggagtttaactggtatatgaccttcctctagcaacactcgactggtaaggaaaaaaatgcctaaaatgaacatgcacacaactttagtaaacatactgtgcatgctcccctcccaagtgctggcaggccactgcgaatgcagacagcctgtcccaagaaaagaaatcaagggaggagagatgcaaaccccggaaccatgccaatgtataaaaccctaagtcaaaggtcaaacagggcacttgtatctctcaagttgcccccttggccctctttttgttcctactctaaagctttttaataaaatcttactcccgctcaaaaacttgcctgagtctctcactctgccttatgcccctcggtcaaattctttccttcaagggggcaagaattgagttgccgcagacccatgttgattaaccgctgc

SEQ ID NO: 423 - DNA, 397 bp, Homo sapiens
gtcaggcctctgagcccaagctaagccatcatatcccctgtgacctgcacgtacacatccagatggcccaaagtaactgaagaatcacaaaagaagtgaaaatggcctgttcctgccttaactgatgacattaccttgtgaaattccttctcctggctcattctggctcaaaagctcccctactgagcaccttgtgactcccacccctgcccaccaaagaacaaccccctttaactaattttcctttacctacccaaatcctatataacagccgcaccccgtctcccttcgctgactctcttttcagactcagcccacctgtacccaggtgaaataaacagccttgttgctcacacaaagcctgtttggtggtctattcacatggacaagagtaaaa

SEQ ID NO: 424 - DNA, 464 bp, Homo sapiens
gtcaggcctctgtgcccaagccaagccatcgcatcccctgtgacttgcacgtatacgcccagatggcctgaagtaactgaagaatcagaaaagaagtgaaaatgccctgccctgccttaactgatgacattccaccacaaaagaagtgaaaatggccggcccttgccttaagtgatgacattaccttgtgaaagtccttttcctggctcttcctggctcatcctggctcaaaaagctcccccactgagcacctcacgacccccacccctgcccgccagagaacaacccccctttctttgactgtaattttcctttacctacccaaatcttataaaacggccccacccctatctccctttgctgactctctttttggactcagcccgcctgcacccaggtgattaaaagctttattgctcacacaaagcctgtttggtggtctcttcacacagacgcacatgaaa

SEQ ID NO: 425 - DNA, 444 bp, Homo sapiens
tacttctcctgctgccccctacccccaccttgcctagtttataagacaggagaaagcaaaaggttggaaagaaacagaagtaagataaatagccagacaaccttggcaccaccacccagccctgggagttaaaataatatcaatccataacctaaaccacttctgttatctgtaaatgccagacgttgtatgaaaaagcgttacaaaactttctgttctgttagctgacacatgtagcccccagtcacgttccccacacttgcttgatttatcacgaccccttcacgtggacccctcagagttgtaagcctttaaaaaggccaagaatttcttttttaaggagctcggctcttaagatgtgagtctgccgaagctcccggccaaagaaacctcttctttctttaatccggtgtctgagttttgtctgcggctggtcctgctaca

SEQ ID NO: 426 - DNA, 973 bp, Homo sapiens
gtgggggaaagaaaaatagatcagactgttattgtgtttatgtagagaaaggaagacataagaaacttcattttgatctgtactaagagaaattcttctgccttgagatgctgttaatctgtaaccctagccccaaccctgtgcttgcagaaacaggtgctgtattgactcaaggtttaatggatttagggctgtgcaggatgtgctttgtgaaaaatgtgtttgcaggcagtatgcttggtaaaagtcatcaccaatctccagtctcgagtacccagggacacaatacactgaggaaggccacagggacctctgcccaagaaagcctgggtattgtccaagatttcttcccatgtgatagcctgagatatggcctcctgggaagggaaagacctgaccatcccccagcccgacacccgtaaagggtctgtgctgaggaggattagtgaaagaggaagccctctttgcagttgagataagaggaaggcatctgtctcctgctcgtccctgggaatggaatgtctcataaaacctgatcatacattctatttaccgagataggagaaaaccgccttgtggttgctgagacatgctggtggcaatactctttactgcactgagatgttcgtgtaaagttaaacataaatctggcctacgtgcacatcaaggcacagcacctttccttaaacttatttatgacacagagtcctttgctcacgttttcctgctgaccctctccccaccattaccctatagtcctgccacatgcccctctccgagatggtcaacatagtgatcaataaatactgagggaattcagagactggggccagcgcgggtcctctgtatgctgagcgctggtcccctgggcccacttttcttcctctatactttgtgtcttatttcttttctcagtctctcgtctccaccttgcaagaaatacccacaggtgtggaggggcaggcccccttca

SEQ ID NO: 427 - DNA, 359 bp, Homo sapiens
gtcaggcctctgagcccaagcctgcacatccagatggcctgaagcaagtgaagaatcacaaaataagtgaaaatggccggttcctgctttaactgatgacattaccttgtgaaattccttctcctggctcagaagctccccaactgagcatcttgtgacccctgcccctgcctgccaaagaacaaccccctttgactgcaattttccactacctacccaaatcctataaaacagccccacccctatctccctttgctgactctcttttcagactcagcccgcctgcacccaggttaaataaacagccttgttgctcacacgaagcctgttaggtggtctcttcacttggacacgtgtga

SEQ ID NO: 428 - DNA, 2495 bp, Homo sapiens
atggaatgagaccaccacttctcctgttgtccttcccagcttccccacctccccttttccctagtttataagacagtagaaaagggagaaagcaaaaagttggaaagaaacagaagtaagataaatagctagacgaccttggcgccgccacctggccctggtggttaaaacaataataataatattaacccctgaccaaaactactggtgttatctgtaaattccagacattgtatgagaaagcactgcaaaactttttgttctgttagctgatgtatgtagcccctagtcacgttcctcacacttacttgatctatcatgaccctttcacgtggaccccttagagttgtaagcccttaaaagggctaggaatttctttttcggggagctcagctcttaagacttgagtctgccgatgctaccagccgaataaaaacctcttccttctcttccttctttaatccgggtctgaggagttttgtctgcggctcatcctgctacatttcttggttccctgaccgggaagcgaggtgattactggatggtcgagtcagccccttaggcagcttaggcctgccctgtggagcatccctgcgggggactccggccagctcgagcgacgtggatcctgagagcgttcccgggtaggcacttgcccctgtggaacgcctcatcagagcagtgtatggcaggcccccatggaggatcaacgcagtggctgaacaccaggaaggaactggcactttaagtctggacatctgaaacttggtaagactggtctttggaacttgccccactccatttgagtggaagcgtggcctgatcacccatggtgtgcctgtactggcattttggtttttgtttttgacttgacttgaattgcttgatactttggttttggttttgacctggcttggatttctggatgctctgattttggttttgattctgtttggtgtaaactgaaaaagtgtgtttgtgcccttttaacccgttctttgttctgtggtgtgcgtggtatgagcttggtgttttgtctcgaggaaacatgggtcagacacaaagtaagctcactccactaggaactatgttgaaaaattttaagaagggatttaatggacactatggggttactatgacatcagagaaacttagaactttgtgtgaaatagattggccaacattagaagtaggttggccatcagaaggaagcctggacagatcccttgtttctaaggtatggcacatggtaactggtaagtcaggacactcagaccagttcccgtacatagacacttggttacagctggtgctagaccccccacagtggctaaaagggcaggcagcagcagtgctagtagcaaagggacagatagccaaggaaggatcccgctccacctgccaagggaaatcaactcccgaagttctgttcaacccaacatcagaagatccattgcaggagatggcaccagtgatcccagtggtgccctccccttaccagagaaagaggctccccactcttgagcccacagtgcttgcacctccacaaaacaaacatatccttaggccacccagagtaaacaagagaggagttgaagcctccggagaaactcctcccttggcagctcatttaagacccaaaactgggatacaaatgctcctgagagagcagcagtatactgggatagatgaggatggtcatgttgtggagaggcatgtttttgcataccagcccttcacctctgccgaccttctcaactggaaaaacaataccccgtcctatactgaaaagccacaagctctaactgatttgctccaaactattatccagacccataaccccacttgggctgattgccaccagctgctcatgttcctctttaacacagatgtaaggtggagagtgctccaagcagcaactaagtggctagaggaacgtgcactggctgattaccaaaatccccaagagtatgtaaggacccagttaccaggaaccgaaccccagtgggacccaaatgaaagagaggatatgcaaaggctaaactgatacagggaagctctcttggaaggattaaagaggggatcccagaaggccacaaatgttaacaaggtctctgaggtcattcagggaaaagaagaaagtccagcacaattctacgagagattgtgtgaggcctatcgtatgcatactccctttgatcctgatagccctgaaaatcagtgcatgattaacatggctttagttagtcaaagcactgaagacattagaagaaaactgcagaaacaggatgggtttgcaaggatgaatacatcacagttattagaagtagctaaccaggtgtttgtaaacagggatgcagtaagctgtaaggaaaattgcaaagagaatgaacgtcaggcccggcgaaacaccgacctgtttgttagctgcagcaatcagaggggtacccccaaagaggcaagggaaggggagccctgggaaagaaactcagcct

SEQ ID NO: 429 - DNA, 1164 bp, Homo sapiens
accccatccacacaagtcttagcaggcacgaaaatagccaccagttacctgagtgtgttggcagcgtcaggattttttggagttgtcctcactcccttatttcattttgacattcttctaaatctaataaactaattcgtctcctcttgccttcaggccatcaagctccagatgatcctcagtgagagacaccatcatgtcagtattcaagagtcacccttctacagaggacccctagacttcccatcaacaagacatgacagaggcttaattccacccctttctccctccagcctggctggatactgtttttaccaacccatggagccatcctaccctgacagctagcaagaggtgaagacccacaaaacaaccaccaccacccctctatcagtaggaagcagttacagaagactgacctttatccatttttcccaaagaattgaggtcttggattcttgaggggggaaatgttatggtaggtaggtagtcagacatgagcaggacaagagagggccctccaaccaccaggaatgtcaggcaaccatcaggtgatggtcaagcggttgttaaactgcctctgtaacataataattggttgcagcaagtgccagggaaaggcagtccctcaacagacagaaaagcctaaaactggtgatcggcttcctgataagacggcaggagttgggcaagtgggcttaagcatactaagaggcaaaatggcacggattaactggtatgtgacttagtaggaacactcaactggtaagggaagaacaactcaagagagcatgcatacaacttcgataaacacactgtgaatacagtgcctaccaagtgctaggaggctactgtgcatgtggacagcccaccccaagggaagaatcaggggaaaagacacacaacctcctgctcccttgtaagcatgccaacatagaaaaccccaagtcaaaggtcaaacagtgcacttgatctctcaagttgcctgcttggccctcttccaagtgtactttacctcctttcattcatgctctaaactttttaataaactttcactcctgctctaaaacttgctttagtctctcactctgccttatgcctcttggtcgaattcttctgaggaggcaagaattgaggttgctgaagacctgtatggatttgcca

SEQ ID NO: 430 - DNA, 472 bp, Homo sapiens
caacagcaatgagcttttcatgagttaaaagaaaaaactcatgttggccccagccctggggctacctgaactggcaaaaccctttacactctatgtgacagaaagagaaaaaatggcagttggagttttaacccagactgtggggccctggccaaggtcagtggcctatctctcaaaacaactggacagggtttccaaaggctggcccccatgtctaagggccctggcagcaacggccctgttagcacaagaagcagataaactaactcttgggcaaaacctgaatataaaggcccctccatgctgtggtaactttgatgaataccaaaggacatcattggctagcaaatgctagattaaccaagtgccaaagcttcctatgtgaaaatccccacataaccattgaagtttgcaacaccctaaaccccaccaccttgctcctggtatcagagagcccagctgaacataactg

SEQ ID NO: 431 - DNA, 708 bp, Homo sapiens
ttagagtaggtagttaggcagacatgagcagggcaggagagggccgcctctgccccaccaggaatgtcaggcaagtatcaggtgatggtcaggtggttgttcaactctctctctaaaataataattttttgcagccaatgacagggaaaggcagtctcccagtagaaagaaagtgcctgaagctggtgatcagcagcttcctgataagatctcatgatttgggcaagtgggctcaagcatgcacactaagaggcaaaatggcagagtttaactggtgtatgaccttcctctaggaacactcgactggtaaaggaaaaatgcctgaagtgagcatgtgtacaactttagtaaacatactgctcatgtggccccttccaactgctggcaggccagtgtgcatatggacagcccaccccaagggaagaatcagagtaagagagatgcaaccccctggatgcatgccaatatataaaaccccaagtcaaaagtcaaacgatgcacttgaatctcccaagttgccacttggccttcttcaaagtgtacattacttcctttcattcctgttctaaaactttttaattgtaactttcactcctgttctaaaacttgcctcagtctctcactgtgccctatgcccctcggtcaaattctttcttctgaggaggcaagaattgaggttgctgcagacctgtatggattcactgctgc

SEQ ID NO: 432 - DNA, 642 bp, Homo sapiens
gtgaggaaaagaaagagagatcagactgttactgtgtctatgtagaaaaacgaagacataagaaactccattctgatctgtacaaagaaaaattgttctgctttgagatgctgttaacctgtaactttagccccaacactgtgctcacagaaacatgtgctgtattgagtcaaagtttaagggatttagggctgtgcaggatgtgccttgttaacaatatgtttgcaggcagtatgcttggtaaaagtcattgccgttctccattctctattaaccagggacacaatgcactgtggaaagccacaggaacctctgcccaagaaagcctgggtattgtccaaggtttccctccactgacacagcctgagatatggcctcgtgggaagggaaagacattaccatcccccccagcctgacacccgtaaagggtctgtgctgaggaggattggtaaaagaggaaggccctttgcagttgagataagaggagggcctctgtttcccacatgtccctgggaatgaaatgtcttggtgtaaagccgaccattcattctattctgagataggagaaaactgccctgtggctggaggcaagatatgctggcagcaatactgctctgttactctttgctacactgagatgtt

SEQ ID NO: 433 - DNA, 5751 bp, Homo sapiens
gtcaggcctctgagcccaagctaagccatcatatcccctgtgacctgcacatatacatccagatggcctgaaataactgaagaatcacaaaagaagtgatatttaaatggcctgttcctgccttaactgatgacattccaccacaaaagaagtgaaaatggccggtccttgccttaaatgatgacattaccttgtgaaattccttctcctggctcatcctggctcaaaaagctccccgactgagcaccttgtgacccccactcctgcctgccagagaacaaccccctttgactgtaattttcctttagctacccaaatcttataaaacggccccactccatctctcttcactgactctcttttcagactcagcccacctgcacccaggtgattaaaaagctttattgctcacacaaagtctgtttggtggggtctcttcacacagacacaagtgaaattttggtgccatgactcggatcaggggaccttccttgggagatcaatcccctgtcctcctgctctttgctccatgagaaagatctacctacgacctcgggtcctcagaccgaccagcccaaggaacatcacaccaattttaaatccggtaagtggcttctttttactctcttctccaacctctctcactatccctcaacctctttctcctttcaatcttggcgccacacttcaatctctcccttctcttaatttcagttcctttcctttcctcgtagagacaggagacacgttttatccgtggacccaaaactctggcgccggtcacggactcgggaagacagtcttcccttggtgtttaatcatgcggggatgcctgcctgattattcacccacatttcagaggtgtctgaccacatggggacgcctgccttggtccttcacccttaacggcaagtactgcttttctggggggcaagaacctcccaaccccttcttcacccttagcggcaagtaccgcttttctagggggcaagaaccccccaccccttctctccatgtctctactctctcttttctctgggcttgcctccttcactatgggcagccttcacccctccattcctccttctcccttagcctgtgttctcaagaacctcttcaactcacacctgacctaaacctaaacgccttattttcttctacaataccgtttggccccaatacaaactcgacagtggttccaaatagccagaaaacggcacttttgatttttccatcctacaagatctagataattcttatcataaaatgggcaaacggtccgagatgcctgacgtccaggcattcttttacacattgttccctccctagtctgttaccaatgtgacttatcccagatcctccttctttccttcccacctgtcccctcagtcccaaccccaagcattgctgagtctttctaatcttccttttctacagacccatctgacctctctgctcctcaccaggccgagccaggtcccaattcttcctcagcttctgctcccccaccctataatccttttatcacctccactccttccacccagtccagcttacagtttcgttctgtgactagccttcccccaccagcccagcaatttcctcttaaaaaggtggctggagctaaaggcatagtcaaggttaatgctcctttttctttatctgacatctcccaaaatcagttagtgtttaggctctttttcatcaaatatgaaaaacccagcccagttcatggctcatttggcagcaaccctgagacgctttaaagccctagaccctgaaaggtcagaaggccgtcttattctcaatatgcattttattttattacccaatctgttcctgacatgaaataaagctccaaaaattaaattctggccctcaaaccccacaacaggacttaattaacctcacctttaaggtgtacaataatagagtagaggcagccaagtagcaatgtatttctgagttgcaattccttgcctccactgtgagacaagccccagccacatcaccagcatacaagaactccaaacgcctgaaccacagctgccaggggttcctctagaatctcctcccccaggagcttgctacaagtgccagaaatctggccactggaccaaggaatgcccacagcccaggattcctcctaagccatgtctcatctgtgcgggaccccactgaaaatcagactgttcaacttacctggcagccactcccagagcccctggaactctgacccaaggctctctgactgactccttcccagatcctctcggcttagcagctgaagactgacactgcccgattgcctcagaagcctacaggaccatcacagatgctctagataactctcacagtggagggtaagtccatccccttcttaatcaatacagaggctactcactccacattaccttattttcaagggcctgtttcccttgcctccataactgtcgtgggtattgacagccaggcttctaaatctcttaaaactccccaactctggtgccaatttagacaatactcttttaagcactcctttttagttatccccacctgcccagttcccttatcaggccaagacactttaactaaattatctgcttccctgactattcctgggctacagccacacctcattgccaccttttctcccagttcaaagcctccttcacatcctccccttgtatctccccaccttaacccacaagtataagatacctctactctctccttggtgaccgatcatgtacccctaccatctcattacaacctaatcacccttaccctgctcaacgccaatatcccatcccacagcacgctttaaaaggattaaagcctgttatcacttgcctgttacagcatggccttttaaagcctataaactctccttacagttcccccattttacctgtccaaaaacctgacaagccttacaggttagttcaggatctgcaccttatcaaccaaattgttttgcctatccaccccatggtgccaaacccgtatactctcctatcctcaatacctccctccacaacccattattctgttctggatctcaaacatgttttctctactattcctttgcacccttcgtcccagcctctctttgctttcacttggactgaccctgacacccatcaggctcagcaaattacctgggctgtactgccgcaaggcttcacggacagcctccattacttcagtcaagcccaaatttcttcctcatctgttacctatctcggcataattatcataaaaacacacgtgctttccccaccgattgtgtccaactgatctctcaaaccccacaccttctacaaaacaacaactcctttccttcctaggcatggttggatactttcgactttggatacctggttttgccataacaaaaccattatataaactcataaaaggaaacctagctgaccccgtagatcctaaatcctttccccactcctctttccattccttgaagagagctttagagactgcccccaccctagctttccctgactcatcccaacccttttcattacccacagccaaagtgcagggttgtgcagtcggaattcttacacaagaaccgggactacgccctgtaacctttttatccaaacaacttgaccttactgttttgcctagccctcaagtctgtgtgcagtggccaccactgccctaatacttttagaggcccttaaaattacaaactatgctcaactcactctctacagttctcataacttccaaactctattttcttcctcacacctgacacatatactttctgctccccggctccttcagctgtactcactctttgttgagtctcccacaattaccattgttcctggcctggacttcaatccggcctcccacattattcctgataccacacctgagccccatgactatatctctctgatccacctgacattcaccccatttccccatacttccttctttcctgttcctcacccagatcacacttggtttattgatggcagttccaccaggcctaatcgcaacacaccagcaaaggcaggccatgctatagttcaagccactagcctgcctcttagaacctctgatttcctttccatcgtggaaatctattctcaaagaaataacttctcagtcttccatctgctattctactactcctcagagattattcaggccccctcccttccctacacatgaagctcagggatttgcccctgcccaggaccggcaaattagctttactcaacatgccctgagtcaggaaactaaaatacctcttggtcttggtagacactttcactggataggtagaggcctttcccacaggatctgagaaatgacccaccacggtcatttctttccttctgtcagacagaattcctcggtttggccttcccacctctatacagtcctgtaagggaccggcctttattagtcaaatcacccaagcagtttctcaggctcttagtattcagtgaactaatggtcttttaaaaccacaccttaccaagctcagccaccaacttaaaaaggactggacaatacttttaccacttgcccttctcagaattcgggcctgtccttggaatgctacaaggtacagcccatttgagctcctgtatagacgctcctttttattaggccccagtctcattccagacactagaccaacttggactgcaccccccaccaaaaaaaaaaaaaaacttgtcgtccctactatcttctgtctagtcatactcctattcaccattctcaactactcataaatgccctgctcttatttacactgccgatttacactgtttctccaagccaccacagctgatgtctcctggtgctatccccaaaccgccactcttaactccctcttaaagtaaataaatcatctttgccggcagggctatgctgaacttccttaggcactctctagttagatgtcctaggtcctcccaattcttactcctttaatacctgtttttctccttgtcttattccattattttttcaattcccacaaaattgtatccaggccatcaccaataattctataagacaaatgtttcttctaacaaccccacaatatccccccttaccacaaaatcttccttcagcttaatctctcccactctaggttcccacgccacccctaatcctgctcgaagcatccctgagaaacatcgcccattatctctccataccacccccaaaaattttcgccaccccaacacttcaacactattatgttttatttttcttactaatataagaagacaggaatgtcaggcctctgagcccaagctaagccatcatatcccctgtgacctgcacgtatacacctagatggcctgaagtaactgaagaatcacaaaagaagtgatatttaaatggcctgttcctgccttaactgatgacattccaccacaaaagaagtgaaaatggccggtccttgccttaactgatgacattaccttgtgaaattccttctcctggctcatcctggctcaaaaatctcccccactgagcaccctgtgacccccccactcctgcccgccagagaacaactgcctttgactgtaattttcctttacctacccaaatcttataaaatgaccccacccctatctctcttcactgactctcttttcagactcagcccacctgcacccaggtgattaaaaagctttattgctcacacaaagcctgtttggtggtctcttcacacggatgcgagtgaaa

SEQ ID NO: 434 - DNA, 3667 bp, Homo sapiens
gtcaggcctctgagcccaagccaagccatcgcatcccctgtgacttgcatgtatacgcccagatggcctgaagtaactgaagaatcacaaaagaagtgaatacgccctgcccccaccttaactgatgacattccaccacaaaagaagtgtaaatggtcggtccttgccttaagtgatgacattaccttgaagtccttttcctagctcatcctggctcaaaaagcacccccactgagcaccttgcgacccccactcctgcccaccagagaacaaaccccctttaactataattttcctttacctacccaaatcctataaaacggccccacccttatctcgcttcactgactctcttttcggactcagcccgcctgcacccaggtgaaataaacagccatgttgctcacacaaagcctgtttggtggtctcttcacacagatgcacatgaaatttggtgccgtgactcggattgggggacctcccttgggagatcaatcccctgtactcctgttctttgctccgtgagaaagatccacctatgaccctcaggtcctcagaccgactagcccaaggaacatctcaccaattttaaatcaggtaagcagcctcttcttactctcttctccaacctctctcactgtccctcaaccactttatcctttccactcttcaatctctcccttctcttaatttcaattcctttcattttctgggagagacaaaggagacacgttttatccgtggacccaaaactctggcgcgggtcacggactgggaaggcagccttcccttggtgtttaatcattgcagggacacctctctgattatacacccatgtttcaagggtgtcagaccacgcagggacgcctgccttggtccttcacccttagcggcaagtcccgcttttctggggaaggggcaagtaccccagccccttctctccatgtctctaccccttctctgcttttctgggagaggggcaagtaccctcaacccattctccttcacccttactggcaagtcccacttttctaggaggggggcaagtacccctcaaccccttctccttcacccttagcggcaagtcctgcttttctatggggcaagaaccaccaatcccttatttccatgccccaacctcttatctctgtgccccaatcccttattcctgtgccccaacctatctctgcaccccaatcccttatttccgtgccccaacctcttatatctttgtaccccaatcccttatttccacaccctgacctcttatctctgcaccccaaccccttttcccacttttctggaaggtaagaacccccaaacccttccctccatttctctactctctcttttctctaggcttgcttccttcactatgggaaccttccaccctccattcctcctcctactcccttggcctgtgttctcaaaaacttaaaacctcttcaactcacacctgacctaaaacctaaatgccttattttcttctgcaataccgcttgaccccaatacaaactcgacagtagttccaaatagccagaaaatggcactttgaatttttcaatcctgcaaaatctaaataattcttgtaaaataggcaaacggtctgaggtgcctgacgtccaggcattcttttacacatcagtcccttcctagcctctgtgcccagtgcaactcatcccaaatcttccttctttccctcccgcctgtcccctcagtaccaaccccaagcatcgctgagtctttctaatcttccttttctacagacccatctgacctctcccttcctccccaggctgctcctcgccaggccgagctaggtcccaattcttcctcagcctctgctcctccaccctacaatctttttatcacctcccctcctcacacctggtccggcttacagtttcgttccgtgactagccctcccccacctgcccagcaatttactcttaaaaaggtggctggagccaaaggcatagtcaaggttaatgctcctttttctttatcccaaatcagaagcgtttaggctctttttcatcaaatataaaaacccagcccagttcatggctcgtttggcagcaaccctgagacactttacagccctagaccctaaaaggtcaaaaggccatcttattctcaaaatacattttattacccaatctgctcccgacattaaataaaactccaaaaattggaatctggccctcaaaccccacaacaggacttaattaacctcaccttcaaggtgtacaataactgaaaaaagttgcaattccttgcctccactgtgagacaaaccccagccacatctccagcacacaagaacttccaaacgcctgaaccgcagtggccaggcgttcctccagaacctcctcccacaggagcttgctacacatgccggaaatctggccactgggccaaggaatgcccgcagcccgggattcctcctaagccgcgtcccatctgtgcgggaccccactgaaaatcggactgttcaactcacctggcagccactcccagagcccctggaactctagcccaaggctctctgactgactccttcccagatcttctcggcttagcagctgaagactgacactgcacgatcgcctcggaagccccctagaccattcacggacgccgagcttcgcgtaactctcacagcggaaggtaagcctgtccccttcttaatcaatacggaggctacccactccacgttaccttcttttcaagggcctgtttcctttgccttcataactgttgtgggtgttgacggccaggcttctaaacctcttaaaactccccaactctggtgccaacttagacaatactcttttaagcactcctttttagttatccccacctgcccagttcccttattaggctgagacactttaaattatctgcttccctgactattcctggactacagctatatctcattgccgcccttcttcccaatccaaatcctctttgcatctgtcctcctcttgtatccccccaccttaacccacaagtataagatacctctactccctctttggcgacggatcatgcaccccttaccatctcattaaaacctaatcacccttaccccactcaacgccaatatcccatcccgcagcacgctttaaaaagattaaagcctgttatcactcgcctgctacagcatggccttttaaagcctataaactctccttacaattcccccattttacctgtcctaaaaccagacaaggcttacaagttagttcaggatctgcaccttatcaaccaaattgttttgcctatccaccctgtggtgcccaaccccatacactcttttgttctcaataccttcctccacaactcactattccgtgcctgatcttaaagatgcttttttcactattcccctgcacccctcgtcccagcctctctttgctttcacttagactgaccctgacacccattaggctcagcaaattacctaggccatactgctgcaaaccttcacagatagaccccattacttcaatcaagcccaaatttcatcctcgtctgttacctatttcagcataattctcataaaaacatacatgctttccctgctgatcatgtccgattaatctcccaaacctcaatcccttacaaaacaacaactcctttccttcctaggcatagttag

SEQ ID NO: 435 - DNA, 964 bp, Homo sapiens
gtggggaaaagaaagagagatcaaattgttactgtgtctgtgtagaaagaagtagacataggagactccattttgttccgtactaagaaaaattcttctgccttgggatgctgttaatctataaccttacccccagccccgtgctctctgaaacatgtgctgtgtccactcagggttaaatggattaagggcggtgcaagatgtgctttgttaaacaaatgcttgaaggcagcatgcaggttaagagtcatcaccactccctaatctcaagtacccaggaacacaaacagtgcggaaggctgcagggacctctgcctaggaaagccaggtattgtccaaggattctccccatgtgatagtctgaaatatggcctcgtgggaagggaaagacctgaccatcccccagcccgacacccgtaaagggtctgtgctgaggaggattagtataagaggaaggaatgcctctttgcagttgagacaagaagaaggcatctgtctcctgcctgtccctgggcaatggaatgtctcggtataaaacccgattgtattttccatctactgagataggggaaaactgccttagggctggagttggaacatgcgggcagcaatactgctctttaaggcattgagatgtttatgtgtatgcatatctaaagcacagcacttaattctttaccttgtctatgatgcagagacctttgttcaggtgtttatctgctgacctctccactattgtcctatgaccctgccacatcctcctctctgagaaacactcaagaatgatcaataaatactaagggaactcagaggcctgcgggatcctccatatgctgaacgctggtcccctgggcccccttatttctttctctatactttgtctctgtgtctttttcttttccaagtctctcgttccacctaacgagaaacacccacaggtgtggaggggcaacccaccccttca

SEQ ID NO: 436 - DNA, 366 bp, Homo sapiens
gtcaggcctctgagcccaagcctgcacgtatacatccagatggcctgaagtaactgaagaatcacaaaagaagtgaaaatggctggttcctgccttaactaatgacattaccttgtgaaattccttctcctggctcagaagctcccccactgagcaccttgtgtcccccacccttccccctgcagagaacaaccccctttgactgtaattttccattacctacccaaatcctatacaacggccccacccctatctcccttcactgactctcttttcggactcagcccgcctgcacccaggtgaaataaacagacttgttgctcacacaaagcctgtttggtagtctcttcagacggacgcgcgtga

SEQ ID NO: 437 - DNA, 5838 bp, Homo sapiens
gtttggcctctgagcccaagccaagccatcgcatcccctgtgactggcacgtatacgcccagatggcctgaagtaactgaagaatcacaaaagaagtgaatatgccctgccccaccttaactgatgacattccaccacaaaagaagtgtaaatggccggtccttgccttaactgatgacattaccttgtgaaagtccttttcctggctcatcctggctcaaaaagcacccccactgagcaccttgcgacccccactcctgcccgccagagaacaacccccctttgactgtaattttcctttacctacccaaatcctataaaacggccccacccctatctccctttgctgactctcttttcggactcagcccacctgcacccaggtgattaaaagctttattgctcacacaaagcctgtttggtggtctcttcacacagacgcgcatgaaatttggtgccgtgagttggatcggggaacctcccttgggagatcaatcccctgtcctcctgttctttgctccgtgagaaagatccacctacgacctcaggtcctcagaccgaccagcccaaggaacatctcaccaattttaaatcaggtaagcagcctcttcttactctcttctccaacctctctcactgtccctcaaccactttctcctttccactcttcaatctctcccttctcttaatttcaattcctttcattttctgggagagacaaaggagacacattttatccgtggacacagaactccggtgccggtcatggactgggaaggcagccttcccttggtgtttaattattgcagggatgcctctctgattattcacccacgtttcaaaggtgtcagaccacgcagggacgcctgccttggtccttcacccttagcggcaagtcccgcttttctgggaaaggggcaagtaccccaaccccttctctccttgtctctaccccttctctgcttttctgggggaggggcaagtacccctcaaccccttctccttcactcttggcggcaagtcccgcttttctagaggaggggcaagtaccccaaccttgtatctctgtgccccaatcccttatttctgcaccccaacctcttatatctctgtgccccaatcccttatttccgtgccccgaccccttatttctgtgcccctaccccttatttccatgcccctaccccttatttctgtgccccatcccttatttctgcaccccgacctcttatctctgtgccccaaccccttttcccacttttctggaaggtaagaacccccgaactccttccctccatttctctactctctcttttctctaggcttgcttccttcactataggcaaacttccaccctccattcctccttctaccccctttgcctgtgttctcaaaaacttaaaacctcttcaactcacacctgacctaaaacctaaatgccttattttcttctgcaatgccgcttgaccccagtacaaactcgacagtagttccaaatagccagaaaatggcactttgaatttttccatcctgcaagatctaaataattcttgtcgtaaaataggcaaacggtctgaggtgcctgacgtccaggcattcttttacacatcagtcccttcctagtctctgtgtgcagtgcaactcgtcccaaatcttccttctttccctcctgcctgtcccctcagtaccaaccccaagcatcactgagtctttctaatcttccttttctacagacccatctgacctctcccttcctccccaggctgctccttgccaggccgagctaggtcccaattcttcctcagcctctgctcctccaccctataatctttttatcacctcccctcctcacacctggtctggcttacaatttcgttccctgactagccctccccctcctgcccagcaatttactcttaaaaaggtggctggagctaaaggcatagtcaaggttaatactcctttttctttatcccaaatcagatagcatttaggctctttttcatcaaatataaaaatccagcccagttcatgacttgtttggcagcaaccctgagacattttacagccctagaccctaaaaggtcaaaaggccgtcttattctaaaatacattttattacccaatctgctcccgacattaaataaaactccaaaaattaaattccggccctcaaaccccacaacaggatttaattaaccttgccttcaagatgtacaataatagaaaaaagttgcaattccttgcctccattgtgagacaaaccccagccacatctccagcacacaagaacttccaaatgcctgaactgcagcggccaggcgttcctccagaatctcctagcacaggagcttgctacatgtgccgtaaatctggccaatgggccaaggaatgcccgcagcccgggattcctcctaagccgcgtcccatctgtgtgggaccccactgaaaatcggactgttcaactcacctggcagccactcccagagcccctggaactctggcccaaggctctctgactgactccttcccagatcttcttggcttagcggctgaagactgacactgcccgatcacctcggaagccccctagaccatcacggacgccgagcttcgggtaactctcacagtggagggtaagcccgtccccttcttaatcaatacagaggctacccactccaattaccttcttttcaagggtctgtttcccttgcctccataactgttgtgggtattgacttgacggccaggcttctaaacctcttaaaactccccaactctggtgccaacttagacaatacttttttaagcactcctttttggttatccccacctgccagttcccttattaggctgagacactttaactaaattatctgcttccctgactattcctggactacagctatatctcattgtcgcccttcttcccaatccaaagcctcctttgtgtcctcctcttgtatccccccaccttaacccacaagtataagatacctttactccctccttggcgaccgatcatgcaccccttaccatctcattaaaacctaatcacccttaccccactcaatgccagtatcccatcctgcagcacgctttaaaaatattaaagcctgttatcattcacctgctacagcatggccttttaaagcctataaactctccttatgattcccccattttacctgtactaaaaccagacaagccttacaagttagttcaggatctgcgccttatcaaccaaattgttttgcctatccaccccatggtgccaaacccatatactctcctatcctcaatacctgcctccaaaacccattattctgttctagatctcaaacatgctttctttactattcccttgcacccttaatcccagcctctcttcgctttcacttggactgaccctgacacccatcaagctcagcaaattacctgggctgtactcctgcaaagcttcacagacagcccccattacttcaatcaagcccaaatttcttcctcatctgttacctatctcggcataattctcataaaaacacacatgctctccctgccaatcgtgtccaactgatctctcaaacccaagcaccttctacaaaacaactcctttccttcctaggcatggttagttcggtcagaattcttacacaagagccaggaccacaccctgtagtgtttctgtccaaacaacttgaccttactgttttagcctagccctcatgtctgcatgcagtggctgccgctgctttaatacttttagaggccctcaaaatcacaaactatgctcaactcacactctacagttctcataacttccaaaatctattttcttcctcacacctgacgcatatactttctgctccccggctccttcagctgtactcactctttgttgagtctcccacaattaccgttgttcctggcccagacttcaatccggcctcccacattattcctgataccacacctgacccccatgactgtatctctctgatccacctgacattcaccccatttccccacatttccttctttcctgttcctcaccctgatcacgcttgatttattgatggcagttccaccaggccgaatcgccacacaccagcaaaggcaggttatactatagtacaagccactagcccgcctcttagaacctctcatttcctttccatcatggaaatctatcctcaagtaaataacttctcagtgttccatctgcttttctactactcctcagggattattcaggccccttcccttccctacacatcaagctcaaggatttgccccacccaggactggcaaattagctttactcaacatgccctgagtcagataactaaaatacctcttagtctaggtagatgctttcactggataggtagaggcctttcctacagggtctgagaaggccactgcagtcatttcttcccttctgtcagacataattcctcggtttagccttcccacctcaatacagtctaataacagacgagcctttattagtcaaatcagccaagcagtttttcaggctcttagtattcagtgaaacctttatatcccttatggtcctccgtcttcaagaaaagtagaatggactaaaggtcttttaaaaacacacctcaccaagctcagccaccaacttaaaaaggactgcacaatacttttaccactttcccttctcataattcaggcctgtcctcagaatgctacagggtacagcccatttaagctcctgtatagacgcccctttttattaggccccagtctcattccagacaccagaccaacttagactgtgccccaaaaaacttgtcatccctactatcttctgtctagtcatactcctattcaccgttctcaactactcatatatgacctgctcttgtttacactgccggtttacactgtttctccaagccatcacagctgatatctcctggtgctatccccaaactgccactcttaactcttgaagtaaataatctttgctggcaggactatgctgaatctccttaggcactctctaatcagatatcctgagtcgtcccaattcttagaccttttatacctgtttttctccttctgttattccacttagtttctcaattcatccaaaaccatatccaggccatcaccaatcattctatacgacaaatgtttcttctaacatcctcaccatatcaccccttaccacaatacctcccttcagcttaatctctcccactctaggttcccacgccacccctaatcccgcttgaagcacccctgcgaaacatcgcccattctctctccataccacccccaaaaaattttcgccgccccaacacttcaacactattttgttttatttttcttattaatataagaaggcaggaatgtcaggcctctgagcccaagccaagccatcgcatcccctgtgactggcacgtatacgcccagatggcctgaagtaactgaagaatcacaaaagaagtgaatatgccctgccccaccttaactgatgacattccaccacaaaagaagtgtaaatggccggtccttgccttaactgatgacattaccttgtgaaagaccttttcctggctcatcctggctcaaaaagcacccccactgagcaccttgcgacccccactcctgcccgccagagaacaacccccctttgactgtaattttcctttacctacccaaatcctataaaatggccccacccctatctcccttcactgactctcttttcagactcagcccgcctgcacccaggtgaaataaacagccatgttgctcacacaaagcctgtttggtggtctcttcacacggatgcacgtgaaa

SEQ ID NO: 438 - DNA, 7489 bp, Homo sapiens
cctctttgggtcccctccctttgtatgggagctctgttttcactctattaagtcttgcttctgcagtcttctggtccatatttgttacggctccagctgagcttttgctcgccgtccacccctgttgtttgccgctgtcgcagacccgccgctgacttccatccctccggatccagcagggtgtctgctgtgctcctgatccagcgaggcgcccattgccactcctgatcggactgaaggcttgccattgttcctgcacggctaagagcctgggttcgtcctaatcgagctgaacactagtcactgggttccacggttctcttccgtgacccacggcttctaatagagctataacactcaccgcatggcccaagattccattccttggaatccgtgaggccaagaaccccaggtcagagaacacgaggcttgccaccgtcttggaagcagcctgccactatcgggagctctgggagtaaggacccccagtaacatttggtgaccacgaagggatctccaaagcaatgggaaacgttccccccaaggcagaaacgcccctgagatgtattctggagaattgggaccaactggactctcacatgctaagaaataaacgacttatattcttctgcagtaccacctggccacgatatcctcttcaagggggagaaacctggcctcctgagggaagtataaattataacactagcttacagctacacctcttttgtagaaaagaaggcataaggagtgaagtgccatatgtacaaactttcttttcattaagagacaactcacaattatgtaaaaagtgtgatttatgccctacgggaagccctcagagtctacctccctaccccagcgtcccctcgactccttccccaactaataaggaccccccttcaacccaaactgtccaaaaggagatagacaaaggggtaaacaatgaaccacagagtgcaattttccccgattatgcccactccaagcagtgggaggagaattcggcccagccagagtgcgtgtaccttcttctctctcagacttaaagcaaattaaaatagacctaggtaaattcttagataaccctgatggctatgttgaggttttacaagggttaggacagtcctttgatctgacatggagagatacaatgttactgctaaatcagacactagctccaaatgagagaagtgctgccataactgcagcctgagagtttggcgatctctggtatctcagtcaggtcaatgatagggtgacaacagaggaaagagaaaaattccccacaggccagcagtcagttcccagtgtagaccctcagtgggacacagaatcaggatatggagattggtgccgcagacatttgctaacctgcgtattagaaggactaaggaaaactaggaagaagcctatgaattattggcaatgatgtccactgtaacacagggaaaggaagaaaatcctaccgcctttctggtgagactaagggaggcattgaggaagcatacctctctgtcacctgattatattgaaggccaactaatcttagaggataagtttatcactcagtcagctgcagacattagaaagaaacttcaaaagtctgccttaggcccggagcaaaacttagaaaacctattgaacttggcaacctcggttttttataatagagatcaggaggagcaggtggaatgggacaaatgggatttaaaaaaaggccattgctttagtcatggccctcaggcaagcagactttggaggctctggaaaagggaaaagctgggcaaatcgaatgcctaatagggcttgctttcagtgcggtctacaaggacactttaaaaaagattgtccaaatagaaataagccaccccctcgtccatgccccttatgtcaagggaatgactggaaggcccactgccccaggggatgaaggtcctctgagtcagaagccactagccagatgatccagcagcaggactgagggtgcccggggcaagtgccagcccatgccatcaccctcacagagccccaggtgtgcttgaccattgagggccaggaggttaactgtctcctggacactggcgtggccttctcagtcttactcttctgtcctggacaactgtcctccagatctgtcactatctgaggggtcctaggacagccagtcactagatacttctcccagccactaagttgtgactggagaactttactcttttcacatgcttttctaattatgcctgaaattgccacacccttgttagggagagacattctagcaaaaacaggggccattatacacctgaacataggagaaggaacacccgtttgttgtcccctgcttgaagtctgggtaacagaaggacaatatggacgagcaaagaatgcccgtcctgttcgagttaaactaaaggattctgcctcctttccctaccaaaggcagtacccccttagacccgaggcccaacaaggactccaaaaaattgttaaggacctaaaagcccaaggcctagtaaaaccgtgcagtagcccctgcaatactacaattttaggagtacagaaacccaatggacagtggaggttagtgcaagatttcgggattatcaatgaggccattgtccatctacacccagctgtacctaacccttatactctgctttcccaaataccagaggaagcagagtggtttacagtcctggaccttaaggatgcctttttctgtatccctgtacatcctgactctcaattcttgtttgcctttgaagatcctttgaacccaacatctcaactcacctggactgttttaccccaagggttcagggatagctcccatctatttggccaggcattaacccgagacttaagccagttctcatacctggacactcttgtcctttggtacatggatgatttacttttagctgcccattcagaaaccttgtgccatcaagccacccaagcgctcttaaatttccttgctgcctgtgactacaaggtttccaaaccaaaagttcagctctgctctcagcaggtttaatacttagggctaaaattatccaaaggcaccagggccctcagtgaggaacatatccagcctatactggcttatcctcatcccaaaactctaaagcaactaagagggttccttggcataacaggtttctgtcgaatatggattcccaggtacggtgaaatagacagaccattgtatacactaattaaggaaacttggaaagtcaatacccatttagtaagatggacacctgaagcagaagcggctttccaggccctaaagaaggccctaacccaagccccagtgttaagcttgccgatggggcaagacttttctttatatgtcataaaaaaaccaggaatagctctaggagtccttacacaggtccgagggacgagcttgcaacccgtggcatacctgaataaggaaattgatgtagtggcaaagggttggcctcattgtttatgggtagtggcagcagtagcagtcttagtatctgaagcagtttaaataatacagggaagagattttactgtgtggacatctcatgatgtgaacggcatactgactgctaaaggagacttgtggctgtcagacaaccgtttacttaaatatcaggctctattacttgaagggccagtgctgcgactgcgcatttgtgcaactcttaacccagtcccatttcttccggacaatgaagaaaagatagaacataactgtcaacaagtaattgctcaaacctacaccgctcgagggggaccctttagaggttcccttgactgatcctgacctcaacttgtatactgatggaagttcctttgtagaaaaaggacttcaaaaagcagggtatgcagtggtcagtgataatggaatacttgaaagtaatctcctcactccgggaactagtgctcagctggcagaactaatagtcctcactcgggcactagaattaggagaaggaaaaagggtaaatatatatacagactctaagtatgcttacctagtcctccatgcccatgcagcaatatggagagaaggggaattcctaatttctgagggaacacctatcaaacatcaggaagccattaggagattattattcgctgtacagcaacctaaagaagtgacagtcttacactgccggggtcatcagaaaggaaaggaaagggaaatagaagggaaccgccaagaggatattgaagccaaaagagccgcaaggcaggaccctccattagaaatgcttataaaaggacccgtagtatggggtaatcccctccgggaaaccaagccccagtactcagaagaagaaatagaatggggaacctcacgaggacatagtttcctcccctcaggatggctagccactgaagaaggaaaaatacttttgctggcagctaaccaatggaaattacttaaaacccttcagcaaacctttcacttaggcattgatagcacccatcagatagccaaatcattatttactggaccaggccttttcaaaactatcaagcagatagtcagggcctgtgaagtgtgccaaagaaataatcccctgccttatcgccaagctccttcaggagaacaaagaacaggcaattacccaagagaagactggcaactagattttatccacatgccaaaatcacagggatttcagtgtctactagtctgggtagatactttcactggttgggcagaggccttcccctgtaggacagaaaagttccaagaggtaataaaggcactagttcatgaagtaattcccagattcggacttccctgaggcttacagagtgacaatggtcctgctttcaaggccacagtaacccagggagtatcccaggcgttaggtatagaatatcacttacactgcacctagaggccacaatcctcagggaaggttgagaaaatgaaacactcaaacgacatctaaacaagctaacccaggaaacccacctcgcatggtctgctctgttgtctatagccttactaagaatccaaaactctccccaaaaagcaggacttagcccatacagaatgctgtatggacggtccttcctaaccaatgaccttctgcttgaccaagagatggccaacttagttgcagacatcacctccttagccaaatatcaacaagttcttaaaacattacaaggagcctgtccccgagaggagggaaaagaaatattccaccctggtgtcatggtattagtcaagtcccttccctctaattccccatccctagacacatcctggggaggaccctacccagtcattttatctatcccaactgcggttaaagtggctggagtggagtcttggatacatcacactcgaatcaaaccctggatactgccgaaggaacccgaaaatccaggagacaacgctagctatttctttgaacctctagaggatctgtgcctgctcttcaagcaacaaccgtgaggaaagtaactaaaatcgtaaatccccatggccctcccttattgtatttttctctttactgttctctcaccacctttcagtctcactgcaccctctccatgccactgtaggaccagtagctccccttaccaagcgtttctatggagaatgcggcgtcccagacatattgatgccccatcgtataggagtttatctaagggaaaccccgccttcaccgcccacacccatatgccccacaactgctataactctgccactctttgcatgcatgcaaatactcattattggacagggaaaatgattaatcctagttgtcctggaggacttggagccactgtctgttggacttagttcacccatactggtatgtctgataggggtggagttcaagatcaggcaagagaaaaacacgtaaaggaagtaatctcccaactgacctgagtacatagcacgcctagcccctacaaaggactagatctctcaaaactacatgaaaccctccgtacccatactcgcctggtaagcctatttaataccaccctcactgggtttcatgaggtctcggcccaaaaccctactaactgttggatgtgcctccctctgcacttaaggccatacatttcaatccctgtacctgaacaagggaacaacttcaacacataaacaccacttccgttttagtaggacctcttgtttccaatctggaaataacccatacctcaaacctcacctgtgtaaaatttagcaatacgatagacacaaccaactcccaatgcatcaggtgggtaactcccccccacgaatagtctgcctaccctcaggaatattttttgtctgtggtacctcagcctattgttgtttgaatggctcttcagaatctatgtgcttcctgtcattcttagtgccccccatgaccatctacactgaacaagattcatacaatcatgtcatacctaacccctgcaacaaaagagtacccattcttccttttgttattggagcaggagtgctaggcggaataggtactggcactggcggtatcacaacctgtactcagttctactacaaactatttcaagaaataaatggtgacatggaacaggtcgccgattccctggtcaccgagcaagatcaacttaacttcctagcagcagtagtccttcaaaatcaaagagttttagacttgctaaccactgaaagagggggaatctgtttatttttaggagaagaatgctgttattatgttaatcaatctggaattgtcaccaagaaagttaaattcaagatcaaatacaacgtagagcagaggagcttcaaaacaccggacttggggcctcctcagccaatggatgctctggattctccccttcttgggacctctagcagctataatattgttactcctctttggaccctgtatctttaacctccttgttaagtttgtctcttccagaatcgaagctgtaaagctacaaatggttcttcaaatggagccccagatgcagtccatgactaagatctaccgtggacccctggaccagcctgctagcccatgctccaatgttaatgacatcaaagtcacctctcccgaggaaatctcaactgcacagcccctaccatgccccagttcagcaggaagcagttagaatggttgtcggccaacctccccaaaagcacttgggttttcctgtggagtagggactgagagacagggctagctggatttcctaggctgactaagcatccctaagcctagctgggaaggtgactgcatccacctttaagcatggggcttgcaacttagctcacacctgaccaatcaggtagtaaagagatctcactaaaatgctaattaggcaaaaacaggaggaaaagaaatagccaatcatctatcgcctgagagcacagtgggaaggacaatgattgggatataaactcaggcattccagccagcaactgctaccctctttgggtcccctccctttgtatgggagctccgttttcactctatgaaatcttgcaactgca

SEQ ID NO: 439 - DNA, 905 bp, Homo sapiens
gtggggaaaagaaagagagatcagattgttactgtgtctgtgtagaaagaagtagacataggagactccattttgttccctactaagaaaaattcttctgccctgagatgctgccaatctgtaacccttcccccaaccctgtgctccccgaaacatgcgctgtgtcaactcagggccaaatggatcaagggctgtgcagggtgtgctttgttaaacaaatgcttgaaggcagcatgcttgttaagagtcatcaccactccccaatctcaaaccactccccaatctcaagtacccagagacacaaaacactgcagaaggccgcagggacctctgcccaggaaagccaggcaccgtccaaggtttctccccatgtgagagtctgaaatatggccttgtgggaagggaaagacctgaccgtcccccagcccgacacccgacacccgtaaaaggtctgtgctgaggaggattagtaaaagaggaaggaacgcctttttgcagttgagataagaggaaggcttctgtctcctgctcatccctgggcaatggaatgtctgggtgtaaagctgattgtatattccatctactgagataggagaaaaccgccttagggctggaggtgggacatgctggcagcaatactgttccttaaggcaatgagatgtttatgtatatgcacatcaaaagcacagcacttttttctttaccttgtttatggtgcagagacatttgttcacgtgtttaccttctgacctccccaccattatcctattatcctgtcacgcccgataatgagcaataaatactaagggaacgcagcagccggggctggcgtggatcctccatatgctgaatgcctgtcccctgggcccctttttcttttttttttttttttttttttttttatt

SEQ ID NO: 440 - DNA, 302 bp, Homo sapiens
tcacaagagaagtgaaaatggctggttcctgccttaactgatgacatcacattgtgaaattccttctcctggctcagaagctctcccactgaataccttgtgactcccgcccctgcccgccagagaacaacccctttgactgtaattttccattacctacccaaatcctataaaactgccccacccctatctccctttgctgactctctttttggactcagcccacctgcacccaggtgattaaaaagctttattgctcacacaaagcctgtttggtgatctcttcacacagatgtgcgtga

SEQ ID NO: 441 - DNA, 454 bp, Homo sapiens
gtcaggcctctgagcccaagccaagccatcgcatcccctgtgacttgcacgtatacgaccagatggcctgaagtaactgaaaaatcacaacagaaatgaatatgccctgccccaccttaactgatgacattccaccacaaaagaagtgtaaatggccagtccttgccttaagtgatgagattaccttgtgaaattccttctcccggctcatcctggctcaaaaagcacccccactgagcaccttgcgacccccactcctgcccgccagagaacaaaccccctttgactgtaattttcctttacctacccaaatcctataaaacggccccacccttatctcccttcgctgactctcttttcggactcagcctgcccgcctgcacccaggtgattaaaagctttattgctcacacagagcctgtttggtggtctcttcacagggacgcgcatgaaa

SEQ ID NO: 442 - DNA, 3135 bp, Homo sapiens
tgactctctttttggactcagcccacctgcacccaggtgaaataaacagccatgttggtcacacaaagcctgtgtggtggtctcttctcatggacgcgcatgaaattcggtgccgtgactcggatcgggggacctcccttgggagatcaatcccctgtcctcctgctctttgctctgtgagaaagatccacctaccacctcaggtccttagacagacaagcccaagaaacatctcaccaatttcaaatccggtaagtggccactttttactctcttttccaatctccctcactatccctcaacctctttctcctttcaatcttggcgtcacacttcaatctctcccttctcttaatttcaattcctttcattttctgggagagacaaagcagacacgttttatcggtggacccaaaactccagcgcctgtcacggactgggaaggcagccttcccttggtgtttaatcattgcagggacacctctctgattattcacccacgtttcaaaggtgtcagaccacgcagggatgcctgccttggtccttcacccttagcagcaagtcccgcttttctgggggaggggcaagttccccaactccttctctccctctctaccccttctctgcttttctggggaaggggcaagtacccctcaaccccttctccttcgcccttagcggcaagtcccgcttttctagggggcaagaacccccaatcccttatttccgcaccccaacctcttatttctgtgccccaatcccttatttccatgccccgaccccccttcccacttttctggagggtaagaacccccgaaccccttccctccatatctctatgctctcttttctctgggtttgcctccttcactatgggcaaccttccaccatccattcctccttctcccttagcctgacttctcacgaacttaaaacctcttcaactcacacctgacctaaaacctaaacgccttattttcttctgcaatgctgcttgaccccaatacaaactcaacagtagttccaaatagccaaaaaatggcactttgaatttttccatcctgcaaaatctaaataattcttgctgtaaaatagacaaatggtctgaggtgcctgatgtccaggcattcttttacacatcagtcccttcctagtctctgtgcccaatgcaactcgtaccaaatcttccttctttccctcccgcctgtcccctcagtcccaaccccaagcgtcactgagtctttctaatcttccttttctacagacccatctgacctctcccctcctctccaggccaagctaggtcccaattcttcctcagcctcccctcctccaccctataatccttttatcacctcccctcctcacaccctgtctggcttatagtttcgttcagtgactagcccttccccacctgtccagcaatttattcttaaaaaggtggctgaagctaaaggcatagtcaaggtgaatgctcctttttctttatcccaaatcagatagcgtttaggctctttttcatcaaatataaaaatccagcccagttcatgacttgtttggctgcaaccttgagacgctttacagccctagaccctaaaaggtcaaaaggccatcttattctcaaaatacattttattacccaatgtgctcccgacattaaataaaattccaaaaattggaatctggccctcaaaccccacaacaggatttaattaacctcaccttcaaggtgtacagtaacagaaaaaaagttgcaattccttgcctccactgtgagacaaaccccagccacatctccagcacacaagaacttccaaatgcctgaaccacagcagccaggtattcctccagaacctccttccccaggagcttgctacacgtgccggaaatctggccactgggccaaggaatgccggcagcccgggattcctcctaagccgcgtcccatctgtgtgggaccccactgaaaatcggactgttcaactcacctggcagccactcccagagcccctggaactctggcccaaggctctctgactgactccttctcggcttagcggctgaagactgacgctgcctgatcacctcgaaagccccgtagaccatcacagacgccgagcttcgagtaactctcacagtggaaggtaagtccgtcgccttaatcaatacggaggctacccactccacattaccttcttttcaagggcctgtttcccttgcctccataactgttgtgagtattgacggccaggcttctaaacctcttagaactccccaactctggtgccaacttagatgatactcttttaagcactccttttagttatccccacctgcccagttcccttattaggccgagacactttaactaaattatctgcttccctgactattcctggactacagctacatctcattgccacccttcttcccaatccaaagcctcctttgcatcctcctcttgtattcccccaccttaacccacaagtataagatacctctactccctccttggcgactgatcatgcaccccttaccatctcattaaaaccttatcacccttaccctgttcaatgccaatatcccatcccacagcatgctttgaaaggattaaagcctgttatcactcgcctgctacagcatggccttttaaagcctataaactctccttacaattcccccattttgcctgtcctaaaaccagacaagccttacaagttagttcaggatctgtgccttatcaaccaaattgttttgcctatccaccctatggtgtcaaacccatatactctcctatcctccatacctccctccacaatccattattatgttctggatctcaagcatgctttctttactattcctttgctcccatcatcccagcctctcttcgctttcacttggactgaccctgacacccattaggctcagcaaattacctgggctgtactgctgcaaggcgtcacagacagcccccattacttcaatcaagcccaaatttcatcctcatctgttacctatctcagcataattcttcataaaaacacaggtgctccccctgctgctcgtgtccgattaatcccccaaacctcaatcccttacaaaacaactccttttcttcctaggtatggttag

SEQ ID NO: 443 - DNA, 2050 bp, Homo sapiens
agtcttttccaactcagggcaagtggttcttaaatcatggaaaattcattcttcctgcctcacaagctcagttcattctttctttccttcatgaccacctccatgtgggatacaagtctctggctcgcctcctacagcccctcatctccttccctctgtggaaatccatccttaagaccatcacctctcaatgctctgtctgccatgccaccagcccccaaggctttctcaggcctcctccttttcctatgcatcaggctcgtggatttactccgacacaagattggcaaattgacttttctcatatgccccatgtccgtaaatttaaatatctcctggtttgggtcgataccttcaccggatgagttgaggcttttcccactagctccgaaaagggtactgccatcatctcttcccttctaacagatataattccccgatttggcctccctgcttctattcaatctgacaatggtcccgcctttattagtcaaatcacccaagcagtttctcaggctcttggtattcagtggaaacttcataccccttaccgtcctcaatcttcaggaaaggtagaacagacgaatggtcttttaaaaacacacctcaccaagctcagcctccaacttaagtacttctaccacttgccctcctcagaattagggcctgtcctcgagaggccacagggtacagtccatttgaacttttatatggacgcactttcttgctgggccccaacctcatcctagacaccagccctctaggcggctatcttccagtcctccagcaggctagacaggaaattcaccgggctgctaatcttctcttgcctactccagattcctagccatatgaagatacctcttttagtacatcctctcatcttttcactttacatttccagttttgccttacacaaggtctctttttccttcgtggcttctccacctacatgtgtttagctgttaattggacaggcacatgtacactagttttccttactcccaaaaatcaatttgcatatgggaccgaacagcttcctgttcccctcatgacaccaacatttcactgctgttttgtttttcttactattaatataagaagacaggaataggcctgaacttgctcactgctgaaaaaggaagactctgcatatttttaaatgaagactgttgtttttacctaaatctatctggcctggtatatgacaacataaaaacactcaaggacagagcccagaaactcgccagtcaagcaaataattatgctgaaccactttgggcactctctagttggatatcctgggtcctcccttagtccttaaatacctgtttttctccttcccttattcagaccttgtatcttccgtttagtttctcaattcctacaaaaccacacccaggccatcagcaatcattctatatgacaaatgctccttccaacaaccccacaatatcatcccttaccccaaaatctttcttcagtttaatctctcccactctaggttcccacgccacccctaatcccactcgaagcagccctgagaaacattgcccattatctctccataccacccccccaaaaactttttgccaccccaacacttcaccactattttgttttgtttttcctattaatataagaagacagtaatgtcaggcctctgagctgaagctaagccatcataacccctgtgacctgcacgtatacattcagatggcctggagcaactcaagaaccacaaaagaggacatttcactattgtgatttgttcctgccccaccccaactaatcaatcaatcaaccttgtgacattccttctcctggacaatgagtctcatgatctccccaccgcaccttgtgaccccgcccctgcccccaagagataaccacctttaactgtaattttccactacctacccaaatcctataaaactgccccaccccatctccctttgctgacactctttttggactcagtccacttgcacccaagggaaataagcagcctcgttgctcacacaaagcctgttggtggactctcttcaca

SEQ ID NO: 444 - DNA, 2156 bp, Homo sapiens
tgcggtcagaatttttacacaagagccaggactgcaccctgtagcctttctgtccaaacaacttgaccttactgttttagcctagccctcatgtctgcttgcagcagctgccgctgctttaatacttttagaggccctcaaaatcacaaactatgctcaactcactctctacatttctcataacttccaaaatctattttcttcctcacacctgacgcatatactttctgcttcccggctccttcagctgtactcactctttgttaagtcccacagttaccattgttcctggcccgaacttcaatccggcctcccacattattctggataccacacctgaccctcatgactgtatctctctgatccacctgacattcaccccatttccccatatttccttctttcctgttcctcaccctgatcacgcttgatttattgatggtggttccaccaggcctaatcgccacacaccagcaaaggcaggctatgctatagtacaagccactagcccgcctcttagaacctctcgtttcctttccatcgtggaaatctatcctcaaggaaataacttctcagtgttccatctgctattctactactcctcagggattatgcaggcctcctcccttccctacacatcaagctccaggatttgccccacccaggactggcaaattagctttactcaacatgcccagagtcagataactaaaatacctcttagtctaggtagacactttcactggataggtacaggcctttcctacagggtctgagaaggccaccgcagtcatttcttcccttctgtcagacataattcctcagtttagccttcccacctctatacagtctgataacagaccagcctttattagtcaaatcagccaagcagtttttcaggctcttagtattcagtgaaacctttatatcccttacggtcctccttcttcaagaaaagtagaacggactaaaggtcttttaaaaacacacctcaccaagctcagccaccaacttaaaaaggactggacaatactttaaccactttcccttctcagaaatcaggcctgtccttagaatgctacagggtacagcccatttgagctcctgtatagatgctcctttttattaggccccagtctcattccagacaccggaccaacttagactgtgcccccaaaaaaacttgtcatccctactatcttctgtctagtcatactcctattcaccgttctcaactactcatacatgccctgctcttgtttacactgccggtttacactgtttctccaagccatcacagctgatatctcctggtgctatccccaaactgccactctaaactcttgaagtaaataaataatctttactggcaaggctatgctgaacctccttaggcactctaattaaatgtcctaggtcctcccaattcttagaccttttatacctgtttttctccttctcttattccgtttttcaattcatacaaaactgtacccaggccatcaccaatcattctaaatgataaatgtttcttctaacaaccccacaatatcaccccttaccacaaaatcttccttcagcttaatctctcccactctaggttcccacgccaccccaatcccactcgaagcagccctgagaaacatcgcccattatctctccataccgtccccaaaaattttcaccgccccaacactttaccactatttcgttttatttttcttatttatataagaagacaggaatgtcaggcctctgagcccaagctaagccatcatatcccctgtgacctacacatacacatccagatggccggttcctgccttaactgatgacattccaccacaaaagaagtgaaaatggcctgttcctgccttaactgatgacactgtcttgtgaaattccttctcctggctcatcctggctcaaaagctcccccactgagtaccttgtgacccccactcctgaccgacagagaacaaccccctttgactgtaattttcctttatctacccaaatcctataaaacggccccacccttatctcccttcgctgactctctttttggactcagcccacctgcacccaggtgattaaaagctttattgttcacacaaagcctgtttggtggtcacttcacacggacgcgcatgaaa

SEQ ID NO: 445 - DNA, 467 bp, Homo sapiens
gcaggagttcagtcagggtggtgggaaaaaatgtagaaagatgcaaaccttggaaggccaaaaggttttacatcagtttcggaacaggatttggctgaaagcagccagattcttttatacggtgcctgaaagcttaggttagataacgggatgttaagaaactgatctagataagttacttagctcggaacctggcctttaatcattcgtaggactgctctctcctgggaggggaaccatgttaattatccacaagtgtgttgactcaaagcctttgccattatatctatactgaataaatgaccacagcaacagctagtcgggaccgcggctgctaactctttacagcaccctcctcagtgtctgtgggtggcccagccccctagctcactctttcactggatacctgtgtttgagtgcatttgttcatctgtcgctgggtcagggtctgcgggtcagacctggca

SEQ ID NO: 446 - DNA, 6233 bp, Homo sapiens
gtcaggcttctgagtccaagctaagccatcctatcccctgtgacctgcatgtatacatccagatggccagttcctgccttaactgatgacattccaccacaaaagaagtgaaaatggcctgttcctgtcttaactgatgacattatcttgtgaaattccttctcctggctcatcctggctcaaaagctcccctactgagcaccttgtgaccccaccttcccgccagagaacaacacccctttgactgtaattttcctttacctacccaaatcctataaaatggccccacccatatctcccttcactctcttttcggactcggcctacctgcacccaggtgattaaaagctttattgctcacacaaagcctgtttggtggtctcttcacagggacgcgagtgaaatttggtgctgtgactcagatcaggggacctcccttgggagatcaatcccctgtcctcctgctctttgctccatgaaaaagatccacctaccacctcaggtcctcagacccaccagcccaaggaacatctcaccaattttacatcgggtaagcagcctcttcttactctcttctccaacctctctcactatccctcatccactttctcctttcaatcttggtgccacccttcaatatctcccttcttttaatttcaattcattttctcatagagacgaaggagacacgtttcatccgtgggcccaaaactccggcgctggtcatggactcaggaaggcagccttcccttggcatttaatcattgcagggatgcctttctgatcattcacccacgtttcagaggtatctcaccacgtggggacacctgccttggtcattcacccttagcagcaagtactggttttctggggggcaagaaccccccaactccttctgtgtctctaccccttctctgcttttctggggggcaagacccccccaacccttctccttcacccttagcagcaagtactgcttttctagttgtcaagaatcccccaatcccttatttctgtgcctcgacctcttatctctgcaccctgatcccttatttctgtgccccaacctcttatctctgcaccccgatcccttatttccacaccccaacctcttatctctgcactccaatcccttatttccatgccccgacctcttatctctgtgccccaaccccttatttccacgccctgacccctttcccgattttctggagggtaagaacccccaaaccccctccctccgtgtctctacccttctctttaaacttgcctccttcactatgggcaaccttccaccccccattcctccttctcccttagcctgtgctctcaagaacataaaacctcttcaactcacacctgacctaaaacctaaactccttattttcttctacaatgccgcttgaccccaatacaaactcaacagtggttccaaatagccagaaaacagcacttttgatttttccatcctacaagatctaaataattcttgtcgtaaaatgggcaaaccgtctgaggtgcttgatgtccaggcattcttttacacatcggtccctccctagtctctgttcccaatgcaactcatcccaaatcttccttccctcccacctgtcctcagtcccaaccccaagcatcactgagtctttctaatcttccttttctacagacccatctgatctctcccctcctcgccaggctgagctgggtcccaattcttcctcagcctccgctcctccaccccataatccttttatcacctcccctccttacacctggtccggcttacagtttcgttccctgactagccctcccccacctgcccagcaatttcctcttaaaaaggcgatagagctaaaggcatagtcaaggttaatactcctttttctttaactgacctctcccaaatcagatagcatttaagctctatttcatcaaatataaaaacccagcccagttcatggctcgtttggcagcaaccctgagatgctttacagccctagaccctgaaaggtcaaaaggccgtcttattctcaatatacattttattacccaatctgctcccgatattaaataaaactccaaaaattaaattccggccctcaaaccctataacaggacttaattaacctcaccttcaaggtgtacaataatagaggcagccaagtagcaatgtatttctgagttgcaattccttgcctccactgtgagacaaaccccagccacatctccagcacataagaactccaagtgcccaaaccacagctgcaaggggttcctccagaacctcctcccccaagagcttgctacaagtgccagaaatctggccactgggccaaggaatgcccacagcccgggattcctcctaagccacgtcccatctgtgcaggaccccactgaaaatcagactgttcaactcacctggcagccactcccagagcccctggaactctgacccaaggctctctgactccttcccagatcttctcggcttagcaactgaagactgacactgcctgattgcctccgaagcctacaggaccatcacagatgctctaggtaactctcacagtggagttaagtaagtccgtccccttcttagtcaatacggaggctacccactccacattaccttcttttcaagggcctgttttccttgcctccataactgttgtgggtgttgacggccaggcttctaaacctcttaaaactcctcaactcgtatgccaacttagaaaacattcttttatgcactctattttagttatccccacctgcccagttcccttattagccatagccacacctcattgctgcccttttccccagttcaaagcctccttctcatcctcctctcatatccccccaccttaacccacaagtataagatacctctacttccttcttggtgaccaatcatgtaccccttacaatctcattaaaacctaatcacccttacccccttcaatgccaatatcccatcccacagcacactttaaaaagattaaagcctgttatcactcacctgcttcagcatgaccttttaaagcctataaactccccttacagttaccccatttcacctgtcctaaaaccacacaaggcttacaggttagttcaagatctgcgccttatcaaccaaattgttttgcctatccaccccatggtgccaaacccatatactctcctatcctcaatacctccctccacagtccattattctgttctagatctcaaacatgctttctttgctattcctttgcagccttcatcccagcctctcttcactttcacttggactgaccctgacacccatcaggctcaacaaattacctgggctgcactgccgcaaagcttcacagacaacccccattacttcagtcaagtgcaaatttcttcctcatctgttacctatctcggcataattctcataaaaacacatgtgctctccctgctgatcgtgtccggctaatctcccaaacctcaatcccttctacaaaacaacaactcctttccttcctaggcatggttagtgcggtcagaattcttacacaagacccaggaccgcaccctgtagcctttctgtccaaacaacttgaccttactgttttagcctagccctcatgtctgcgtgcagcagctgccactgctttaatacttttagaggcccaaaaaatcacaaactatgctcaactcactctctacagttctcataacttccaaaatctattttcttcctcatacctgatgcgtatactttctgcttcatggctccttcagctatattcactctttgctgagtctcccacaattaccattgttcctggcacggacttcaatccggcctcccacattattccggataccacacctgaccctcatgactgtatctctctgatccaactgacattcaccccatttccccatatttccttatttcctgttcctcaccctgatcacatttagttcattgatggcagttccaccaggcctaatcgccactcaccagcaaagtcaggctatgctatagtatcttccacatctatcattgaggctaccgctctgcccccctccactatctctcagcaagccgaactagttgccttaactcaagccctcactcttgcaaaaagactaagcatcaatatttatactgactctaaatatacctttcatattttgcaccaccatgctgttatataggctgaaagaggtttcctcactatgcaaaggtcctccatcattaatgcctctttaataaaaactctgctcaaggccgctttacttccaaaggaagctggagtcattcactgcaaaggccatcaaaaggcgtcagatctgactgctctaagcaacgcttatgctgataaaagtggctagacaagcagctagctttccaacttctatcccttacgtccagtttttctccttcacatcggtcattctcacctactcccccgctgaaacttccacctatcaatctcttcccatacaaggcaaatagttctgagaccaaggaaaatatctccttccagcctcacaagcccattctattattctgtcgtcatttcataacctcttccatgtaggttacaagctgccaatccgtctcttagaacctctcatttcctttccatcctagaaatctatcctcaaagaaatcacttctcagtgttccatctgccattctactacccctccctttcctacacatcaagctcagggatttatttacccctgcccaggactggcaaattgactttactcacatgccccgagacagaaaactaaaatacctcttagtctgggtagacactttcactggataggtaggggcctttcctacagggtctgagaaggccaccgcagtcatttctgcccttctggcaaacataattccgcagtttagccttcccacctctatacagtctgataacagaccagcctttattagtcaaatcagccaagcagtttttcaggctcttagtattcagtgaaactttatatccctcacagtccttagtcttcaggaaaagtagaacggactaaaggtcttttaaaaatacacctcaccaagctccgccaccaacttaaaaagaactggacaatacttttactactttcccttctcagaagtcaggcctgtcctcagaatgctacagggtacagcccatttgagctcctgtatagatgatcctttctattaggccccagtctcatcccagacaccagaccaacttgaactgtgccccaaaaaacttgtcatccctactatcttctgtctagtcatactcctattcaccattctcaactactcatacatgccctgctcttgtttacactgccggtttacactgtttctccaagccatcacagctgatatctcctggtgctatccccaaaccaccactcttaactcttaaagtaagtaaataatctttgctggcaaggctatgccgaaccactttaagcactctctaattagatgtcctaagtcctcccaattcttagtcctttaatacctgtatttctccttctcttactctgtttagtttttcaatccatacaaaacggtatccaggccatcaccaataattttacatgacaaatgtttcttctaacaaccccacggtatcaccccttaccacaaaatcttccttcagcttaatctctcccactctaggttcccacgccacccctaatcccgctcgaagcagccctgagaaacatcgcccattatctctccataccatcccccaaaattttcgccgtcccaacattttacaactatttccttttatttttcttattaatataagaagacaggaatgtcaggcctctgagtccaagctaaaccatcacatcccctgtgacctgcacgtacacatccagatggccagttcctgccttaactgatgacattccaccacaaaagaagtgaaaatggcctgttcctgccttaactgatgacattatcttgtgaaattccttctcctggctcattctggctcaaaagctcccctactgagcaccttgtgacccccacaccttcccgccagagaacaacccccctttgactgtaattttcctttacctacccaaatccagaaaaatggccccacccctatcttccttcgctgactctcttcggactcagcccgcctgcacccaggtgattaaaagctttattgctcacacaaagcctgtttggtggtttcacatggacgtgagtgaaa

SEQ ID NO: 447 - DNA, 5815 bp, Homo sapiens
gtcaggcctctcagcccaagctaagccatcatatcccctgtgacctgcatgtacacatccagatggccagttcctgccttaactgatgacattccaccacaaaagaaatgaaaatggcctgttcctgccttaactgatggcattatcttgtgaaattccttctcctggctcatcctggctcaaaagctcccctactaagcaccttgtgacccccactcctgcctgccagagaactacccccctttcctttacctacccaaatcctatagaatggctccaccccgtctcccttcgctgactctctttttggactcagcccacctgcacccaggtgaaataaacagccttgttgctcacacaaagcttgtttggtggtcttttcacatggatgtgagtgaaatttggtgccatgactcagatcgggcaagctcccttaggagatcaatcccctgtcctcctgctctttgctccgtgagagagagccacctatgacttctggtcctcagaccaagcagcccaagcaagatctcaccaattttaaatctggtaagcagcctctttttactctcttctccaacctccctcactatccctcaacctctatctcctttcaatcttggtgccacacttcaatctctcccttctcttaatttcaattcctttcattttctggtagagacaaaggaggcacattttatccgtggacccaaaactctggcgctggtcatggactagggaaggcagccttcccttggtgtttaatcattgcagggacacctctctgattattcacccaggtttcagaggtgtcagaccacgcagggacgcctgtcttggtccttcacccttagcggcaagtcctgcttttctgggggaggggcaagaacccttcaacaccttctctttcacccttagtggcaagtcccgcttttctggaggaggggcaggaatcccgacctaatatctctgcaccccgatcccttatttccatgccccaacctcttatctctgtgccccaaccccatatttccacgccctgaccccttctctgcttttctggagggcaagaaccccccaccccttctctgtgtctctactctcttttctctgggcttgcctccttcactatgcacaagcttccaccttccattcctccttcttctcccttagcctgtgttcttaagaacttaaaacctcttcaattctcacctgacctaaaatctaagcatcttattttcttttgcaatgccgcttgaccccaatacaaactcgacagtagttccaaatagccggaaaatggcactttcaatttttccatcctacaagatctaaataattcttgtcaaaaaatggccaaatggtctgaggtgcctgacatccaggcattcttttatacatcggtccctccctagtctctgttcccaatgcaactcgtcccaaatcttccttctttccctcccacctgtctcctcagtcccaaccccaagcatcactgagtctttctaatcttccttttctacagacccatctgacctctcccctcctccccaggctgctcctcaccaggctgagctaggtcccaattcttcctcagcctccactcctccaccctataatccttttatcacctcccctcctcacaccaggtctggcttacagtttcattccctgactggccctccccaacctgcccagcaatttactcttaaaaagttggctggagttaaaggcatagtcaaagttagtggtcctttttctttatcccaaatcagatagcatttaggctctttttcatcaaatataaaaatccagcccagttcatgactcgtttggcagcaaccctgagatgctttacagccctagaccctaaaaggtcaaaaggccgtcttattctcaatatacattttattacccaatctgctcccgatattaaataaaactccaaaaattaaattccagccctcaaaccccacaacaggacttaattaacctcgccttcaaggtgtacaataatagagtagaggcagccaagtagcaacatatttctgagttgcaattccttgcctccactgtgagacaaaccccagccacatctccagcacacaagaacttccaaacacctaaaccgcagtggccaggtgttcctccagaacctcctcccccaggagcttgctacaagtgccagaaatctggccaccaagccaaggaatgcctgcagcccgggattcctcctaagctgtgtcccatctgtgggggaccccagtggaaatcagactgttcaactcacctggcagccactcccagagcccctggaactctggcccaaggctctctgctgactccttcccagatcttcttggcttagcggctgaagactgacactgcccgattgcctcggaagccctgtagaccatcacggacgccgagctttaggtaactctcacggtggagggtaagtccgtccccttctgaatcaatacggaggctacctactccacattactttcttttcaagggcctgtttcccttgcctccataactgttgtgggtattgacagccaggctgctaaacctcctaaaactccccaaatctggtgtcaacttagacaatactcttttaagcactcctttttagttatccccacctgcccagtttccttattaggctgagacactttaactaaattatctgcttccctgactattcctggagtacagctacatctcattgccgcccttcttcccaatccaaagcctcctttgcttcctcctcttgcatccccccaccttaacccacaagtataagatatctctactccctccttggtgaccaatcatgcaccccttaccatctcattaaaacctaatcacccttgccctgcttaatgccaatatcgcatcccacagcatgctttgaaaggattaaagcctgttatcactcgcctgctacagcgtggccttttaaagcctataaactctccttacaattcccccattttacctgtcctaaaaccagacaagccttacaagttagttcaggatctatgccttatcaaccaaattgttttgcctatccaccccatggtgctaaacccatatactctcctatacttgataactccctccacaatccattattctgttctggatctgaaacatgctttctttactattcctttgcacccttcatcccagcctctctttgctttcacctggactgaccctgacacccatcaagctcagcaaattacctaggctttactgctgcaaagcttcacagatagcccccattacttcagtcaagcccaaatttcttcctcatctgttacctatctcagcataattctcagaaaaacacatgcactctccctgctgatcgtgtccagctaatctcccaaaccccaatcccttctacaaaacaacaactcctttccttcctgggcatggttggatactttcacgtttggatacctggttttgccatcctaacaaaaccattatataaactcacaaaaggaaacctagctgaccccatagatcctaaatcctttccccactcctctttccattccttgaagacagctttagaggctgcccccatcctagctctccctgactcatcccaacccttttcattacacacagccgaagggcagggctgtgaagtcggaattcttacacaaggaccgggatcacgtcctgtagcctttttgtccaaataacttgaccttactgttttaggctggccatcatgtctccatgcagcggctgctgccgccctaatacttttagaggcccttaaaatcacaaaatatgctcaactcactctctacagctctcataatttccgaaatctattttcttcctcacacctgacacgtatactttctgctccctggctccttcagctgtactcactctttgttgagtctcccacaattaccattgttcctggctcggacttcaatgtggcctctcacattattcctgataccacacttgaccctcatgactgcatctctctgatccacctgacgttcaccccatttccccacatttccttcttccctgtttctcaccctgatcacacctggtttattgatggcagttccaccaggcctaatcgccacatgccagcaaaggcaggctatgatatagtacaagccactagcctgcctcttagaacctctcatttcctttccatcatggaaatctatcctcaaggaaatcacttctcagtgttccatctgctattctgctacttctcagggattattcaggccccctcccttccctacacatcaagctcagggatttgcccccacccaggactggcaaattagctttactcaacatgccccgagtcaggaaactaaaatacctcttggtctaggtagacactttcactggataggtacaggcctttcccacagggtctaagaaggccaccacggtcacttcttcccttctgtcagtcaaaattactcggtttggccttcccacctctaggcagtccaatagtagaccggcctttattcatcaaatcagccaagcagtttttcaggctcttggtattcagtgaaacctttatatcccttacagtcctcagtcttcaggaaaggtagaatggactaatggtcttttaaaaacacacctcaccaagctcagtcaccaacttaaaaaggactagacagtacttttacctctttcttttctcagaatttaggcctgtcctcagaatgctacagggtacagcccatttgagctcctgtatggacgctccattttattaagccccagtctcattccagacatcagaccaacttggactgtgccccaaaaacttgtcatccctactatcttctgtctagtcatactcctattcaccgttctcgactactcatatatgccctgctcttgtttacactgccggtttacaccgtttctccaagccatcacagctgatatctcctggtgctatccccagactgccactcttaactcttaaagtaaataaataatctttgctggcaaggctatgctgaacctccttaggcactctctaattagatgtcctaagtcctcccaattcttagtcctttaatacctgtttttctccttctcttattccctttagtttttcaatacatacaaaaccgtatccaggccatcaccaataattctaaatgacaaatatttcttctaacagtcccacaatgtcaccccttaccacaaaatcttccctcagcttaatctctcccactctaggttcccatgctacccctaatcccgctcaaagcagccctgagaaacatcgcccattatctctccatactatccccccaaattttcgccatcccaacactttaccactatttcgttttatttttctcattaatataagaagacaggaatgtcaggcctccgagcccaagctaagccatcatatcccctgtgacctgcacatccacatccagatggccggttcctgccttaactgatgacattccaccacaaaagaaatgaaaatggcctgttcttgccttaactgatggcattatcttgtgagattccttctcctggctcatcctggctcaaaagctcccctactgagcaccttgtgacccccactcctgcctgccagagaacaacccccctttttcctttacctacccaaaccctataaaacagccccacccctatctcccttcactgactctcttttcggacacagccctgcacccaggtgaaacaaacagccttgttgctcacacaaagcctgtttggtggcctcttcacagggacgcaagtgaaa

SEQ ID NO: 448 - DNA, 444 bp, Homo sapiens; identical to SEQ ID NO: 425

SEQ ID NO: 449 - DNA, 6139 bp, Homo sapiens
gtcaggcctctgagcctaagctaagccatcatatcccccgtaacctgcatgtacacatccagatggccagttcctgccttaactgatgacattccaccacaaaagaagtgaaaatggcctgttcctggcttaatggatgacattatcttgtgaaattccttctcctggctcatcctggctcaaaagctcccctactgagcaccttgtgacccccactcctgcccaccagagaacaacccctttgactataattttcctttacctacccaaatcttataaaacggccccaacccatctcccttcgctgactctcttttcggactcagcccgcctgcacccaggtgaaatgaacagctttattgctcacacaaagcctgtttggtggtctcttcacacggacgtgcatgaaatttggtgccatgactcggatcgggggacctcccctgggagatcaatcccctgtcctcctgctctttgctccatgagaaagatccacctacgacctcaggtcctcagaccaccagcccaagaaacatctcaccaatttcaaatccagtaagcggcctctttttactctcttctccaacctccctctatccctcaacctctttctcctttcaatctgggcgccacacttcaatctgtcccttctcttaatttcaattcctttcattttctggtagagacaaaggagacacattttatccatggacccaaaactccggcgctggtcacggactaggaaggcagccttcccttggtgtttaatcactgcagggatgcttctctgattattcacccacgtttcagaggtgtcagaccacgcagggacgcctgccttggtccttcacccttagcggcaagtcccgcttttctgggggacttgccaaccccttctctccatgtctctaccccttctctgcttttatgggggaagggcaagaactcctcaaccccttctccttcacccttagtggcaagtcccgcttttctaaggggcaagaacccccaatcccttatccctgcatcctgacctcttatctctgtgccccaatcccttatcactgtgccccaatgccttatttccgtgccccaacctcttatctccatgccctgaccccttatttccatgccccgacccctttcccacttttctggagggtaagaacccccgaaccccttccctccatgtctctactctctcttttctctgggcttgcctccttcactataggcaaccttccacccttcattcctccttcttctcccttagcctgtgttctcaagaacttaaaacctcttcaactcacacctgacctaaaacctaaatgccttattttcttctgcaacaccggttggccccaatacaaacttgacaatggctctaaatggccagaaaacggcactttcaatttctccatcctacaggacctaaataatttttgtcgaaaaatgggcaaatggtctgaggtgccttaagtccaggcatttttcacacttcattccctccctagtctctgttcccaattcgattcctcccaaatcctccttttttccctcccacctgtcccctcagtcccaaccccaagcattgctgagtctttccagtcttccttttctacagacccatctgacctctcccctcctcctcaggctgctcttcaccaagctgagctaagtcccaattcttcctcagcctccgctcctccacctataatacttctaccacctcccctcctcacacccggtctggcttacagtttagttccatgactagctcttccccacctgcccagcaatttcctcttagagaggtgcctggagctgaaggcatagtcaaggtacatgtacctttttctctatcagaccgctctcagatcagtcaatgtttaggctctttctcatcagaccccactaaatacatacaggaattctgatatctaactctgtcctacaatttaacctggagtgacttaaatgtcatcctgacttctaccctctccccagatgaacgggaaagagttttttctctagcccaatctcatgctgacaaccgctggcttcatgagccagacctccaggaaggcattagagcagttccccgagaggatccccaatggaactaccaggcaaattccccaggtatagctaggcgagattacatgatttcctgcctagttgaagggcttaaaaaggcagcttacaaagctgttaattatgacgagcttaaagaaactacccaaggtaaagacgaaaacccagcccggttcatggcccgcttagcagcaacacttagacactttactgccctagacccagaggggccagaaggccgccttattcttaatatgcattttatcacccaatccactcctgaaattaggaaaaaactccaaaaattaaattccggccctcaaactccacaacaggacttaattaaccttgccttcaaggtgtacaataatagaaaaaagttgcaattccttgcctccactgtgaggcaaaccccagccatatctccagcacacaagaacttccaaacgcctgaactgcagcggccaggcattctccagaacctcctcccccaggagcttgctacaagtgccaaaaatctggccaccaggccaaggaatgcccgcagcccacctgaactgcagcggccaggcgttcctccagaacctcctaccccaggagcttgctacaagtgccaaaaatctggccaccaggccaaggaatgcccgcagcccgagattcctcctaagccatgtcccatctgtgcaggactccactggaaattggactgttcaactcacctggcagccactcccagagcccctggaactctggcccaaggctctctgactgactccttcccagatcttctcggcttagcggctgaagactgacgccgcccggtcacctcggaagccccgtagaccatcacagatgccgagctttaagtaactctcacagtggaaggtaagtccgtccccttcttaatcaatacagaggctgcccactccacattaccttcttttcaaaggcctatttcccttgcctccataactgttgtaggtattgacggctaggcttctaaacctcttaaaactccccaactctggtgccaacttagacaatactcttttaagcactcctttttagttatccccacctgcccagttcccttattaggccgagacgctttaactaaattatctgcttccctgactattcctggactacagctacatctcattgccgcccttcttcccaatccaaagcctcctttgcgtcctcctcttgtatcccccaccttaacccacaagtataagatacctctactccctccttggcgactgatcacgcaccccttaccatctcattaaaacctaatcacccttaccccactcaatgccaagatcccatcccacagcatgctttgaaaggattaaagcctgttatcactcgcctgctacagcatggccttttaaagcctataaattctccttacaattcccccattttacctgtcctagaaccagacaagccttacagtttagttcaagatctgtgccttatcaaccaaatggttttgcctatccaccccatggtgccaaacccatatactctcctatcctcaatacctccctccacaacccattattctgttttagatctcaaacatgctttctttactattcctttgcacccttcatcccagcctctgttcactttcacttggactgaccctgacactcatcaagctcagcaaattacctgggctgtactgccgcacgtcttcacagacagcccccattacttcagtcaagcccaaatttcttcctcatctgttacctatctctgcgtaattctcataaaaacacacttgctctccctgccgatcatgtccagctgatctctcaaacccctacaccttctacaaaacaacaactcctttccttcctaggcatggttagtgtggtcagaattcttacacaagagccgggactgcaccctgtagcctttttgtccaaacaacttgaccttactgttttaggctggccatcatgtctccatgcagcagctgctgccgccctaatacttttagaggccctcaaaatcacaaactatgctcaactcactctctacagctctcataatttccaaaatctattttcttcctcacacctgatgcatgtactttctgctccccagctccttcagctatactcactctttgttaagtctcccacaattaccattgttcctggcccggacttcaatctggcctcccacattatttcagataccacacctgaccctcatgactgcatctctctgatccacctgatgttcatcccatttccccatgtttccttctttcctgttcctcaccctgatcacacttagtttattgatggcagttccaccaggcctaatcgccacacaccagcaaaggcagcctatgatatagtacgagccactagcccacctcttaaaacctctcatttcctttccattgtagaaatctatcctcaaggaaataacttctcagtgttccccctgctattctactacttctcagggattattcaggccccctcccttccctatacatcaagctcgaggatttgcccccacccaggactggcaaattagctttactcaacatgcccgagtcagataactaaaatacctcttaatctaagtagacactttcactggatagatataggcctttcctatagggtctgagaaggccttctcagtcatttcttcccttctgtcagacataattcctcagtttagccttcccacctctatacagtttgataacagaccagcctttattagtcaaatcagccaagcagtttttcaggctcttagtattcagtgaaacctttatatccctaacagtcctcagtcttcaggaaaagtagaacggactaaaggtcttttaaaaacacacttcgccaagctcagccaccaacttaaaaagtactggagaatacttttaccactttcccttctcagaagtcaggcctgtcctcagaatactacaaggtacaacccatttgagctcctgtatggacactcctttttattaggccccagtctcattccagacaccagaccaacttggactgcaccccaaaaaacttgtcatccctactatcttctgtctagtcatactcctattcaccattctcaactactcatacacgccctgctcttgtttacactgccagtttacactatttctccaagccatcacagctgatacctcctggtgctatccccaaactgccactcttaactcttaaagtaaataaataatctttgctggcaggactatgctgaatcctcttaggcactctctaattagatgtcctaagtcctcccaattcttagtcctttaatacctgtatttctccttctcttattccgtttagtttttcaatccatacaaaaccatatccaggccatcactaataattctacacgacaaatctttcttccaacaaccccacatcaccccttaccacaaaatcttccttcagcttaatccctcccactctaggctcccacgccgcctgtaatcccgctcaaagcagccctgagaaacatcacccattatctctccatactaccaccaaaaattttcaccaccccaacactttaccactatttcattttatttttcttattaatataagaagacaggaatgtcaggcctctgagcctaagctaagccatcatatcccctgtgatctgcatgtacacatccagatggccagttcctgccttaactgatgacattccaccacaaaagaagtgaaaatggcctgttcctgccttaactgatgacattatcttgtgaaattccttctcctggctcatcctggctcaaaagctcccctactgagcaccttgtgaccccaactcctgcccgccagagaacaacccctttgactataattttcctttacctacccaaatcctataaaacggccccacccatatctcccttcactgactctcttttcggactcagcccgcctgcacccaagtgaaataaacagctttattgctcacacaaagcctgtttggtggtctcttcacacggatgcgcatgaaa

SEQ ID NO: 450 - DNA, 277 bp, Homo sapiens
gtaggagatcagtcagggtggcgggaaaaactgtggaaagatgcaaaccttcttggaaggctgggaggttttacaaaagcttcggaaaaggatttggctgaaggcagccagattctcttatccggtgcctaaaagcttaggttagatagaaaggggatgaggggtgaccatgttaattacccacaagtgtgttgactcaaggcctctgtcattaaatctgtactaaataaatgcctgcagccccagcttgtcagggctgcagctgctacaactcttt

SEQ ID NO: 451 - DNA, 1924 bp, Homo sapiens
accatcctattaaaacctaatcactcttaccctgctcaatgccaatatcttatcctatagcatgctttgaaagaattaaagcctgttatcattcacctgttacagcatggccttttaaagcttataaactcttcttgacattcacctcatttccccatatttccttctttcctcttcctcgccttgatcatgcttgatttattgatggcagttccaccaggcctaattgccacaccagcaaaggcaggctatgctatagtacaagccactatcccacctcttagaacctctcatttcctttccatcgtggaaatctatcctcaaggaaataacttctcagtgttccatctgctattctactactcctcagggattattcaggccccctcccttccctacacatcaagctcaaggatttgcccccacccaggactggcaaattagctttactcaacatgtcccgagtcagataactaaaatacctcttagtttaggtagacactttcactggataggtagaggcctttcctacagggtctgagaaggccaccgcagtcatttcttcctttctgtcagacataattcctcagtttagccttcccaccactatacagtctgataacagaccagcctttattagtcaaatcagccaagcagtttttcaggctcttagtattcagtgaaacctttatcccttatggtcctccgtcttcaagaaaagtagaatggactaaatgtcttttaaaaacacacctcaccaagctcagccaacaacttaaaaaggactggacaatacttttaccactttcgcttctcagaagtcagacctgtcctcaggatgctacagtgtacagcccatttgagctcctgtatagatgctcctttttattaggccccagtctcattccagacaccagaccaacttagactgtgcccccaaaaaacttgtcatccctactatcttctatctagtcatactcctattcactgttctcaactactcatacatgccctactcttgtttacactgccagtttgcattatttctccaagccatcacagctgatatctcctggtgctatccccatactgccactctaaactcttgaagtaaataaataatctgctggcaggactatgctgaatctccttaggcactctctaatcagatgtcctaggtcctcccaattcttagaccttttatacctgtttttctccttctcttattccatttagtttttcaattcatacaaaaccgtatccaggccatcaccaataattctacaccacaaatatttcttctaacaactccacaatatcaccttttaccacaaaatcttccttcagcttaatctctcccactctaggttcccacgccacccctaatcctgctcgaagtagccctgagaaacattgcccattatctctccataccacctccaaaaattttcaccatcccaacactttaccactatttcattttatttttcttattaatataagaagacaggaatgtcaggcctctgagcccaagctaagccatcataccccctgtgacctgcatgtacacatccagaaggccagttcctgccttaactgatgacattccaccacaaaagaagtgaaaatggcctgttcctgccttaactgatgacattgtcttgtgaaattccttctcctggctcatcctggctcaaaagctcccctactgagcaccttgtgaccccaactctgcccgccagagaacaacccccctttgactgtaattttcctttatctccccaaatcctataagacagctccacccttatctcccttcgcagagtctcttttcggattcagcccgcctgctctcgggtgattaaaagctttattgctcacacaaagcctgtttggtggtctcttcacatggaggtgcatgaaa

SEQ ID NO: 452 - DNA, 7777 bp, Homo sapiens
gtcaggcctctgagtccaagctaagccatcatatcccctgtgacccgcatgtatacatccagatggcctgaagcaactaaagatccacaaaagaagtgaaaatagccagttcctgccttaactgatgacattccaccattgtgatttgttcctgccccaccctaactgatcaattgactttctgacaatacaccctccccacccttgtgataactactttgtgatattcccccacccttgtgaatgtactttgtatgatacaccctccccacccttgagaaggtaatttgtaatatcctcccctacccttaacaaggtactttgtaatattctcccccacccttaagaaggtactttgggccgggcgcggtgtctcacgcctgtaatcccagcactttgggaggccgaggtgggtggatcacgaggtcaggagattgagaccatcctggctaacatggtgaaaccccatctctactaaaaatacaaaaaaaattagctgggtgtggtggcgggcacctgtagtcccagctactcgggaggctgaggcagaagaatggcgtcaacctgggaggtggagcttgcagtgagccaagattgcgccactgcactccagcctgggcaacggagcaagactccgtcaaaaaaaaaaaaaagtactttgtaatattctccccatccttgagaatgtacttggtaagatccaccccctgcccacaaaacattgctcctaactccattgcctattccaaacctataagaactaatgataatcccaccaccctttgctgactctctttttgggctcagcccacctgtacccaggtgattaaaaagctttattgctcacacaaagcctgtttggtggtctcttcatacagacacacgtgacatttggtgccaaagacccgggggagggggactccttcgggagaccagtcccctgtcctcaccctcactccatgaggagatccacctaccatcttgggtcctcagaccaaccagcccaaggaacatctcaccaatttcaaatcaggtaagcggtcttttcactctcttctccaacctctcttgctgttgctccacccttcaatctctcccttccttaattttggttcctttccctttctggtagagacagaagagacgtgttttatccataaactcaaaactccagcgctggtcactccagacagtcttccgttggtgtttaatcactgtggggatgcctgcctgattattcacccacatttcagggatgtctgatcactgcggggatgcctgccttgatccttcaccttggtggcaagtaccacctcccctgggtggcaagcaccacctcccctgggtggcaagtaccactccctcctcctccatgtctctaccctctcttttctctgggcttgcctccttcactatgggcaaccttccaccctccattcctccttcttctcccttagcctgtgttcttaagaacttaaaacctcttcaactctcacctgacctaaaacctaagcattttattttcttctgcaacattacttggtgtcaatacaaacttgataatggctctaaatggccagaaaatggcacttttgatttctccattctacaagacctagataatttttgtcaaaaaatgggcaaacggtctgagatgcctgatgtccaggcattcttttacacctcggttcctccctagtctctgctcacaatgcgacccatcccaaatccttctttctctcctgactgttccttcagtctccaccccaagctctgagtcctttgaatcctcctttactacagactcatctgacctctcccctcctccccaggctgctcctcgccaggctgagccaggtcccaattcttcctcggcctccactcccccaccctataatccttctatcacctcccctcctcacacctggtctggcttacagttttgtaccgcaactagccctccgccacctgcccaacaatttcctctcaaagaggtggctggagctaaaggcatagtcaaggttaatgctcctttttctctatcagacctttcccaaatcagttagcatttaggctctttttcaccaaatataaaaacccagcccagttcatggcccatttggcaacaacccttggatgctttactgccctagacccagaggggccagaaggctgtcttattctcaatatgcattttattatccaatccagtcccgatattagaaaaagttccaaaaattagattccggccctcaaaccccacaaaagaacttaattaacctcgccttcaaggtgtacaataataaaaaagaggcagccaagtgccaacatatttctgagttgcaattacttgcctccactgtgagagaaaccccacccacacatttctagcacacaagaactttgaaactcctaaaccacagcagccaggcattcctccaggacctcctcccccaggatcttgcttcaagtgctggaaatctggccactgggccaacgaatgcccacagcctgggattcctcctaagccatgtcccatctgtgcggaccccactggaaatcagactgtccaattcgcctagcagccactcccagagcccctggaactctggcccaaggctctctgactgactccttcccagatcttctcagcttagtggctgaagactgacgctgcccgatcaccttggaaacctcctggaccatcacagctttaggtaactcttacagtggagggtaagtccatccccttcttgatcaatatggaggctacccactccacattaccttcttttcaagggcctgttccccttacctccataactgttgtgggtattgacggccaggctgcgagaccccttaaaactcccccactctggtgccaacttggacaacattcttttatccactcctttttagttatccccacttgcccagttaccttattaggtcaagacattttaactaaattatctgcttccctgactattcctgggctacagccacacctcactgccacccttttccccagttcatagcctccttcgaatcctccccttgtatctccctaccttaatccacaagcatgggatccctctactccctccttggcgactgatcatgcaccccttatcatcccattaaaatctaatcacccttaccatgctcaacgccaatatcccatcccacagcaggctttaaaaaggttaaagcctgttaccaccagcctgttacaacatggcctcttaaagcctacaaactctccttacaactctcctatcctacctgtccaaaaaccagacaagtcttacaggctggtccaagatctttgccttatcaaccaaattgtcttgcctatccaccccatagtgccaaacccatatactctcctatcctcaatacctccctccacaacccattattctgttctggatctgaaacatgctttctttactattcctttacacccttcatcccagcctctcttcactttcacttggactgaccctgacacccatcagtcccagcaacttacctgggctgtactgccacaaggcttcagggacagcccccattacttcagtcaagccctttctcatgatttactttctttctgtccatctgcttctcaccttattcaaaattttgacaaccttctcctttatagcccaccctacaagtcttcccaacagggcaccctcctgctcctccaacatctattctcaaaaggatattgcatatccccctccaaagcccaaatttcttcctcatccgttacctatctcagcacctttcttcataaaaacacacgtgctctccctgctgattgtgtccggctaatctcccaaaccccaaccccttctacaaacaacaactcctttccttcctaggcatggttaaggtactttctcctttggatatctggttttgccatcctgactaaaccattatataaactcacaaaaggaaacttagctgaccccataaatcctaaatcctttccccattcccctttccattccttaaaaaacaaccctaaaagctgctctccctaactcatcccaacccttttcattacacacagctgaagtacagggctgtgcagtcagaattcttacacaagagctgggactgcaccctgtagcctttctgtccaaacaacttgaccttactgttttagactagccctcatctctgtgtgcagcagctgctgctgctctaatacttttagaggccttcaaaatcacaaactatgcttaactcactccctacagttctcataacttccaaaatctattttcttcctcacacctgatgcatatactttctgcccctggctccttcagctatattcactctttgttgagtctgcaacgattaccattgttcctggcccggacttcaatccagcctcccacattattcctgataccccacctgacccccataactgtatctctctgatctaacttgtattcactccatttccccatatttccttctttcctgttcctcaccctgatcacacttggtttattgatggcagttccaccaagcctaatcaccaatcactagcaaaggcaggctatgctatagtatcttccacatctatcattgaggctactgctctgccccactccactacctctcagcaagccaaactcattgccttaactcgagccctcactcttgcaaaaggactacgcatcaatatttatacagactctaaatatgccttccatatcctgcaccatcatgctgttatatgggctgaaagaggtttcctcattacacaagggtcctccatcattaatgcatctttaataaaaactcttctcaaggccgctttacttccaaaggaagctggagtcattcactgcaagggccatcaaaaggcatcagatcccattgcttagggcaacgcttatgctgattaggtagctgaagaagcagctagcattccaacttctgtccctcatggccagtttttctccttctcatcagtcactcccacctactctcccactgtaacttccacctatcaatctcctctcacacaaggcaaatggttcttggaccaaggaacatatctccttccagcctcacaggcccattctattctgtcatcttttcagaacctcttccatgtaggttacaagccactagcctgcctcttagaacctctcatttcctttccatcgtggaaatctatcctcaaggaaatcacttcttagtgttccatctgctattctactactactcagggattgttcaggcccgctcccttccctacacatcaagctcagggatttgcccctgtccaggactggcaaattgatttacttacatgccctgagtcaggcaactaaaatacctcttggtctgggtagacactttcactggatggatagaggcctttcccacaggatctgagaaggctaccgcagtcatttcttccctttttccagacataattccttggtttggccttcctacctctatacagtctcatcacagaccagcttttattagtcaaatcacccaagcagtttctcaggctctattcagtggaagcttcataccccttaccgtcctcaatcttcaggaaaggtagaacggactaatggtcttttaaagacacacctcaccaagctcagcctccaacttaaaaaggactggacagtacttttacctcttgcccttctcagaattagagcctgtcctcgagatgctacagggtacagtccatttgaacttttatatggatgcactttcttgctcggacccaaccttgccccagacaccagccctctaggcgactatcttccagtcttccagcaggctagacaggaaatttgccaggctgctcatcttctcttgcctactccagattcccagccatatgaagacaccctagctggatgataagttcttgttaaaaatctgacccttcaaactctacaacctcgatggactggaccctacttagtcatctctagtaccccaactgctgtccgcctgcaggaccctccccattgggttcaccattccagaataaagctttgtctgtcagacagacagcctgatctctcctcttcctcctggaagtcgcaagtactcaaccctacttcccttaaactcacccgcattcctaaatgataatagtaacccttataagcctaatacatcctatcatttttattaggtctcttcgtccttaccctactcttcccaacaaagctttacgcattcacccctcccacttggattgcaccccaaaaacttgtcatccctactatcttctgtctagtcatattcctattcaccattctcaactactcataagtgtcgtgcccctgtttacactgccagtttacatttttcctccaaaccatcacagcggatatctcctagtactatccccaatccgccactcttgactccctcttggagtggatagatgatctttgctcacagggcacactccaatactttcaccctgatgaagtcctattctttacttttacactcactcttattctcattcccgttcttgtgccaccctctacctctccccagctacctccaccacactatcaatctcactcactctctcctagccgtttctaaaccttctttaacaaacgattgttggctttgcatttctttttcctccaaaatcgccgaggctttgacttactgctaaaaaaaaaggggactctgtatattttttaaaagaagagtgttgcttttacctaaatcaatctggcctggtatatgacaacatcaaaaactcaaggattgagcccaaaaactcaccaaccaagcaaataattacactgaacccccttgggcactctctaattggatgtcctgggtcctcccatttcttagtcttttaatatctgtttttctccttctcttatttggaccttgtgtcttctgtttagtttctcaattcatacaaaactgcatccaggccatcaccattctatatgacaaatgttccttctaataaacccacaatatcaccccttaccccaaaatctttctttaatctttcccactccaggttcccatgctgcccctaatcctgctcaaagcagccatgagaaaaattgcccattatctctccataccacccccaaaaatattttgccgccccaacacttcaccgctattttgttctatttttcttattaatataagaagacagaaatgtcaggtctctcagctgaatctaagccatcatatcccctgtgacctgcacatatacatccagatggcctgaagcaacttaagattcacaaaagaagtgaaaacagccagttcctgccttaactgatgacattccaccgttgtgatttgttcctgccccaccctaactgatcaattgactttgtgacaatacaccctccccgccctcgcaataatgtactttgtgatattcccttgcctttgtgaatgtactttgtactatacaccctccccaccattaagaaggtactttgtaatattctcccccacacttaagaaggtactttgtaatattctccacatccttgagaatatactttgtaagatccacccgctgcccgcaacaaaattgctcctaactccaccgcctatcccaaacgtataagaactaatgacaatcccaccaccctttgctgactctcttttcggactcaggctgcctgcacccaggtgattaaaaagctttattgcttacacaaagcctgtttggtgatctcttcacacagacgcgcgcatgaaa

SEQ ID NO: 453 - DNA, 6021 bp, Homo sapiens
gtcaggcctctgagcctaagctaagccatcatatcacctgtgacctgcacatacacatccagatgaccagttcctgccttaactgatgacattccaccacaaaagaagtgaaaatggcctgttcctgccttaactgatgacattgtcttgtaaaattccttctgctggctcatcctggctcaaaagctcccccactgagtaccttgtgaccccaactcctgcccgccagagaacaacccccctttttcctttacctacccaaatcctacaaaatggccccaccccatctcccttcgctgactctctttttggactcagcccacctgcacccaggtgttaaaagcttttattgctcacacaaagcctgtttggtggtctcttcacatggatacgcatgaaatttggtgctgtgactcagatcgggggacctcccttgggagatcaatcccctgtcctcctgttctttgctccatgagaaagatccacctacaacctcaggtcctcagaccgaccagcccaagaaacatctcaccaacttcaaatccggtaagtggcctctttttactctcttctccaacctccctcactatccctcaacctctttctcctttcagtcttggtgccacacttcaatctctcccttcccttaatttcaattcctttcattttctggtagagacaaaggagacacattttatccgtggacccaaaactccagtgctggtcacggactgggagggcagacttcccttggtgtttaatcatagcagggatgcctctctgattattcacccacgtttcagaggtgtcagaccacgcagggatgcctgccttggtccttcacccttagcagcaagtcctgcttttctggaggaggggcaagtaccccaaccccttctctccatgtctcttaccccttctctgcttttctggaggagaggcaagaagccctcaaccccttcttcacccttagcagcaagtcccgcttttctggaggaagggcaagtaccccaacctcatatctctgtgccccgatcccttatttctacaccccaacctcttataactttgcaccccgacccctttcccgcttttctggaaggtaagaacccctgaaccacttccttccgtgtctctaccctcccttttcttgaaacttgcctccttcactataggcaaccttccaccctccattcctcctccttctcccttagcctgtgttcttaagaacataaaacctcttcaactgtcacctgacctaaaacctaaatgccttattttcttctacaatgctgcttgaccccaatacaaacttgacagtggttttaaatggccagaaaacggcactttcgatttctccatcctacaagacctaaataatttttgtcgaaaaataggcaaatggtctgaggtgcctgacatccaggcattcttttacacatcggtccctccctagtctctgtgcccagtgcaactcgtcccaaatcttccttctttccttcccgcctgtcccctcagtcccaaccccaagcgttgctgagtctttctaatcttacttttctacagacccatctgacctctcccctcctccccaggctgctcctcgccaggccgagctaggtcccaattcttcctcagcctccgctcctccaccctataatctttttatcatctcccctcctcacacccggtccggtttacagttccattccgtgagtagccctcccccacctgcccagcaatttcctcttaaaaaggtggctgaagctaaaggcatagtcaaggttaatgctcctttttctttatcagacctctcccaaatcagtaagcatttaggctctttcatcaaatatgaaaaacccagtccagtttatggctcgttcagcagcaaccctgagacgctttacagccctagaccctaaaaggtcaaaaggccgtcttattctcaatatatattttattacccaatccactcctgacattaaataaaactccaaaaattaaattccagccctcaaaccccacaagaggacttaattaaccttgccttcaaggtgtacaataatagagtagaggcagccaagtagcaatgtgtttctgagttgcaattacttgcctccactgtgagacaaaccccatccacatctccagcacacaagaacttccaaacgcctgaaccgcagcggccagatgttcctccagaaccacctcccccaggagcttgctacaagtgccagaaatctggccaccaggccaaggaatgcccgcagcccaggattcctcctaagcggtgtcccatctgtgcaggaccccactagaaatcggactgttcaactcacctggcagccactcccagagcccctagaactctggcccaaggctctctgactgactccttcccagatcttctcggcttagcagctgaagactgatgctgcccgatcaccttggaagccccgtagaccatcaagaacaccgagctttaagtaactgtcacagtggaggataagtccgtccccttcttaatcaatatggaggctacccactccatattaccttcttttcaaaggcctgtttcccttgcctccataactgttgtaagtattgagagccaggcttctaaacctcttaaaactccccaactctagtgccaacttagacaatactcttttatgcactcttttttagttatccccacctgcccagttcccttattaggccgagatattttaaccaaattatgtgcttcactgactattcctggactacagccacatctcattgccacccttctccccaacccaaagccacctttgcgtcttcctctcgtatcccctcaccttaacccacaagtataggacatctctactccttccctggcaaccgatcacatgcccgttaccatcccattaaaacctaaccacacttaccctgctcaacgccagtatcccatcccacagcacgctttaaaaggattaaaacctgttatcacttgcctgctacagcatagacttctaaaacctataaactctccttacaattcccccattttacctgtccaaaaaccggacaagtcttacagattagttcaggatctgcgccttatcaaccaaattgttttgcctatccatcaatccatacactgttttgtcctcaataccttcctccacaactcactattccattctcaatcttaaagacgctttttcactattcccctgcacccctcatcccagcctctctttgctttcacccagactgaccctgacacccatcagtcccagcagcttacctgggctgtgctgccgcaaggtttcaaggacagccctcattacttcagacaagctctttctcatgatttactttctttccacccctccgcttctcaccttattcaatatattgatgaccttcttctttgtagccccacctttgaatcttctcaacaagacacacttctgctccttcagcatttattctccaaaggatatcaggtatccccctccaaagctcaaatttcttctccatccgttacctacctcggcataattcttcacaaaaacacacgtgctctccctgccgatcgtgtctaactgatctctcaaaccccaaccccttctacaaaacaacaactcctttccttcctaggcatggttgtatactttcgcctttagatacctggttttgccatcctaacaaaaccattatataaactcacaaaaggaaacttagctgaccccatagatcctaaatcctttccccactcctctttccgttccttgaagacagctttagagactgcccccactctagctctccctgactcatcccaacccttttcattacacacagctgaagtgcagggctgtgcaggcagaattcttacacaaggaccaggatcgcgtcctgtagcctttttgtccaaacaacttgaccttactgttttaggctggccatcatatctctgtgcagtggctgctgctgccctaatacttttagaggccctcaaaatcacaaactatgctcaactcactctctacagctctcataatttccaaaatctattttcttcctcacacctgatgcatatactttctgctccccggctccttcagctgtactcactctttgttaagtcccacaattaccattgttcctggccctgacttcaatccggcctcccacattattcctgataccacacctgacccccatgactgtatctctctgatccacctgacattcaccccatttccccaaatttccttctttcctgttgctcaccctgatcacgcttgatttattgatagcagttccaccaggcctaatagccacacaccagcaaaggcaggctatgctatagtacaagccactagcccgcctcttagaacctctcatttcctttccatcgtagaaatctatcctcaaggaaataatttctcagtgttccatctgctattctactactcctcagggattattcaggccccctcccttccctacacatcaagctcgaggatttgcccccacccaggactggcaaattagatttactcaacatgccccgagtcagaaaactaaaatacctcttagtctaggtagacactttcactggataggtagaggcctttcctacagggtctgagaaggccaccgcagtcatttcttcccttctgtcagacataattcctcagtttagccttcccacctctatgtagtttgataacagaccagcttttatcagtcaaatcagccaagcagtttttcaagctcttaggattcagtgaaacctttatatcccttatggtcctccatcttcaggaaatgtagaacggactaaaagtcttttaaaaacacacatcaccaagctcagccaccaacttaaaaaggactgaacaatacttttaccactttcccttctcagaattcaggcctgtcctcggaatgctacaaggtacagcccatttgagctcctgtattgacgctcctttttattaggccccagtctcattccagacaccagaccaacttagactgtgccccaaaaaacttgtcatccctactatcttctgtctagtcatactcctattcgccgttctcaactactcatacatgccctgctcttgtttacactgccagtttacactgtttctccaagccaccacagctgatatctcctggtgctatccccaaactgccactcttaactcttgaagtaaataaataatctttgctggcaggactatgctgaatctccttaggcaccctctaatcagatgtcctaggtcctcccaattcttagaccttttatacctgtttttctccttctcttattccatttagtttttcaattcatataaaaccatatccaggccatcaccaataattctacaagacaaatatttcttctaacaaccccacaatatcaccccttaccacaaaatcttccttcagcttaattgctcccactctaggttcccacgccacccctaatcccgcccgaagcagccctgagaaacatcgcccattatctctccataccacccccaaaaattttcactgtcccaacactttaccactatttcattttatttttcttattaatataagaagacaggaatgtcaggcctctgagcccaagctaagccatcatatcccctgtgacctgcatgtacacatccagacggccagttcctgccttaactgatgacattccaccacaaaagaaatgaaaatggcctgttcctgccttaactgatgacattgtcttgtgaaattccttctcctggctcatcctggctcaaaagctcccccactgagtaccttgtgacccccattcctgcccgccagagaaaaaccccctttttcctttacctacccaaatcctataaaacagccccaccccatctcccttcactgactctcttttcgttctcagcctgcctgtacccaggtgattaaaagcttttattgctcacacaaagcctgtttggtggtctcttcacatggacacgcatgaaa

SEQ ID NO: 454 - DNA, 497 bp, Homo sapiens
aaggaatgagaccaccacttctcctgttgtccttcccagcttctacccaaccttcccttttccctagtttataagacaggagaaaagggagaaagcaaaaagttggaaagaaacaaaagtaagataaatagctagacgactttggtgccaccacctggccctggtggttaaaataataataataatattaacccctgaccaaaactactggtgttatctgtaaattccagacattgtatgagaaagcactgtaaaactttttgttctgttagctgatgtatgtagcccccagtcacgttcctcatgcttacttgatctattatgaccctttcacatggaccccttagagttgtaagcccttaaaagggctaggaatttcttttttggggagtttggctcttaagacgcgagtctgccgacgctcccggccgaataaaaacttcttccttctttaatccggtgtctgaggagttttgtctgtgactcgtcctggtata

SEQ ID NO: 455 - DNA, 7718 bp, Homo sapiens
gtaggagattggtcagggtggtgggaaaagttataaggagagacgcaaaccttcttggaagtcctgggaggttttgcaaagcttcgggagagaataaaggctgaaggcagctaaattctcttaccctgaggctaagggcaagtagtaggtaacaaaggagtgtaaaggaatttatctagataagtttatttacttttgccgacctttgatcatccgacctttgatcatccgacctttgatcatctgacctttgatcatctgacctttgatcatccgacctttgatcatctgacctttgatcatccgcgtgcaggactgctccctacaggcgggggcaacaactacccacagattgtgttggctccaggcctttgtcattaaatctgtactaaataaatacaagcagctccagcttattggggctgcgttctctcttcggcgtctctaaggccgagcagtttcctagctgcgctcacgcaaaatacctgtgtctgcgtacttttttcatccgtcgctcggccagagtcggtggatcagactcagcagctggtgcccctcgtgaggaacactgcaagggatcacgacggaacccccgaaaatgaaggcgaagagactgtgcagtcagtaagtcattggtgcccactcgggatatccaagttcaggggaattctcagactagagtttcatcatgagacaacagctgtccgcacaacagaaacagtatataaaagtattgaaacaactgcttaaagctagcagagcctcggtttcacaggctcagttaagggtcctaaggcaaactgttgtttcccataatccatggttcccagcagaaggcatgctggacctagagctctgggaataagtggggagaaatcttaaacaataccataaacaagggcaacgggtcccagtaacatctttaaccttatgggccttagttagggctgctttggccctgctgtacacagaagatcccaagaagggaagggagaaggaaccatcacctaccttaccgccgcctcctcttccctcagccctgccattactgggtaaagataccaaagaggaaacagaggttttccctgagccccctcccccaataaattggaaaaaagacaagggatacactacagctgtgggaccctgtcttaggcaagtggcattagaaggggagctcttaacctgcccggtaatgcaagatcagcaaggtactcaggtatatgaacccatttcttttgacgcttataaagataagaaaaagcatcagagcaaacggagctgctagtccatttatgaaaggattaattgaagccatagcagacaacttctgtttggccccatgggactggtcagtgctagctaaaacaactttagagcccagtcagtacctcctctggaagacagagtatgatgagttgtatgaacaacaagccaaccagaatcaattggccgggcaaaacataacagctgctatgcttcaggggaggggttcctatgccagtgtccaacaacaattaagttttgttccctaagcctatgcacaagtgtctttgtgtgctatgagggcttgggactgaattcccgaattccgaaagcggaagttcaacaaggatctttataaatgttcgacaagggcctcaggagccattttttgaatttatcaatcggttaacccaggcaattaagagacaaattagtcatccccaggccgctgataatcttattgttgcagttggcttatgaaaatgctaacgtcgactgccaacaagcaatgcaggcagtcagaggaaaggcagttacggccagggaacttacacgagcacgtcaactggtggggactgaaacacacaaagccaaaatattggccatggcaataaagtctcctgaagtgaaaagggagaaaaccccaaattgttttctgtgtggagagccaggtcataagaagaggcagtgccccactagtagagaccaaggtaactcagcaaaagaacccccttctatatgcccccgacgtagaaaggggaaacgttgggcaaatcagtgcaagtccaaatttgataaagatgccaaccacctaagtaatcaggtgggaaacttcatgaggggccagccccaggccctgctccaaacttgggcaatgccagcggctttcctcggtcaattggaaagcccacagtccactctctcagaacagccacctctgggagcgcaggattgggcttactctgccccaacgaattagtgctaaaaggagaagaccctaaaaggattgcaacagggatctggggcccactgcctccagaacagtgggattggtcctaggatgatcaagcctatccagcaaaggaattaatgtgctcaccagggtaattgatagtgattatcaagattgaggtattagttatgatggagtgtaaaggtctgcatattcttccccctaaatctaaaatagctcagttactattcttaccgtactgggtccccaatgcccagggaaagaggaagggaagttttggaagcacgggagccgtaggagtgtattggaaccagttaatcactgatcagagacccatgattaccttaaaaatcggaaataagaattttactggcttataggatacaggggtgaatatttcgattattagttatcaaaactggtcagaaacttggccttgggtcactcagaaacaaaaaattgtcagcactggctaagtgcacacagccaagcagagcacacaccccctaacgttgtgatttggagggaaaaaacagttagcaactctaaacatgactgtccctgttaacctttggggacgggaccgattagcccaatgggggctgcaaacccctttctaataatggccactgttgttattcttcccctacccctgacgtggttctctcaagatccaatttgggtagcacagtggcctttaaagggagggaaataacagtgagcccatgagttagttcagcaattaaaagccagccatatagaaccatcaagcagcccttagaatttgcccattttcatcattcccaaaaggtctgggaaatggggacttgcatgacttacgggctatcagtggcagtttgcaacctatggggccccttcaacggggctcccttcccctgtggcaattcttcaagataggcctatagtcgatattgacttaaaagactgctttaatactattccccttgcagaacagggcagagaacaatttacatttaccatactagctatcagtaatgaaagggcagcttgccaatttcattggaaagtacttcctcaaggaatgctgaacagtcctaccatgtgtcagcatcatgtaaatcaggctttgctccccagtagaaaaaaatttcctaattgcaagattattcattttgtagatgatattttactagcagacccaacagagccaatacttttgagtttatatgcctctgtcgttaagatgttaatcatagcacctgaaaaagtacagatgtcctcaccttggaaatatcttaggtacatactaacttcctggtcagtaagacctcaaaaggttaaattaaatactagcaacttacataccttaaatgattatcaaaaattactgggtgatattaactggcatccccccaccttgggcataactactgataaattacagaacctgttttctatcctaaaaggcagtgctgccctagactcacccaggtatttaacccccgcagcaaaaagggaaattgaggaaatagaccaagttatttctcagagacaactagatagcatagatccacgatattcagttcagttgtttgtttttcctgctaaacactcctctacaggattaataggacagatggccacagggctgcgcttcctagaatgtgttttttgctcacatactgggactaaaacactatttggctatatccagctagttagtaaagtcatctatatgggctgcagacgatgcaatctgtggctgggttatgaccctgaatgtcataagaattttcttgagtagaaattcgaagtagtcttgctccatctctagattttcaattagcactctttgattatgcaggccatataaaatatgcccttcctgctggcagactatttcagttcttatctcatactcctctagttttgccaacaaaagtagttcactccctcatacctaaagctttaacgctttttactgatggctctggtaaaaatggaaaagcggctatttggtggaaaccacataattccctcactcaatctggatttactaccgctcagggagctgaggttggagccctagtactggccctagaaaccgaatccgttcagcccattaacattgttagtgactctgtttgtttgttgcaaaaccttgagaccgccctcattaagtccactctcgagcctaccctgtgtacaccttttcttggacttcagcaattgctgggtcaacatacacagttttatcacacatattcgagcacacagctcactgccttgcccactggcttatggcagtgatcaagcagacctgcagcttatgacgtcactgcttgaccaagccacccagtcgcttcagtttttccaccaaaattagagaaacttaacaatagcagcttacccaaagactgggtaaacaaattatcctgcagtgcccagattgccagctcacaggcacatctcttccttgaacaggtgttaaccttagaggactagaaccttatccattatagcaacagatgttacacacgtccctaaatttggaatactaagatatgtacatgtatccattgataccagttcctacctaattagcgcacatgctcttcctggagagtccacacgatacatcattaaacatcttttaacttttgcgtttatggggtggcccacaaaaattaaaactgataataatctggcctgtgccagctcacatattcaacaattttgtcacacatggagcatccaacattccacaggcatcccgtataactgacaggccatagtagaacgtgcccactccacccttaaaaatatgctcagaaaacaaaaaggggaaaatgagtaaggaccctgcaacactactagcacaagtgttatttacccttaatttctaaaatttaaatgataaatttcaatcaactatagaaaagcaccttgctaaaacctctcaagacataaaacccgcagttttatggaaagatgtaaatagtaacgtatggtgtagtccaaatgaattgctaacgtggggaagatgatatgcttgtgttcacacccccctcaggccctctttggattccagtacgatgcatcagaccataccatggcgtggctaggacccaacacagtaccagaagtgaaggaaatgatcctgcaggacccgcagctccagacaacacagcttcctcagacgacacaagccccggacattacctgggggatgctgaagaagacaacttacaaggctgagcaaatcctgctccagacacagaaaccattcactccagataatttgttccttgctctgctctctggtgtaagttacaactcacgtaggatcctttttatgctctcgcttcccctgcaacccgtaccggctacactctattgggctcatctgttagatccgcctttcttacgccctgttacctgggcaggcacccccttcccagcctctaataacgttaactgcttggctaggagggattgacttatcccagtagggtccgttattaatggcacacattggactaaggtgccaggtaacactacatatcactccattatcttcccactgtgtgtaaggttactatgtacctgccgaaacacaattatggctacaaatggcaaaggaattgccttaacattcttgtgccagtagcctcaaaccgggcaaggcaatcagtgccactttccccagcattcttccctgtgctaaagaacaaagccaggaaagtaatggattccactttggttgggaggtctgtcacgggggacaagcccttagtctccagttaggcaatttaacatcttagactggagcccccacggtcatttacagggcgaccatactgatgtttgcatccattgtggtgtcaatcttagtttcatagccatgtccgttcccctgtgatttgggccaaaggggggatgggatatcccagaccccaagtagagtccttgccaccccaagacacttaatggcatctgggacatcttagcaccacccttaacacctggcatgggacataacataattccagtaacaattatactatgacctttatgcataatcacacagatcagtgcctgatttgcactacccatccatatgtttttcttatgggaaccagtatttccattacacctcaaaactccatgtttgtgacctgagtgcaaggacaggcttgcttcacctcatgtatcattaattacaatatatctaatttaaatattactagtattatggtattaaggagacaatctgaggcattcctaccagtcagtttgatacacgattggcaaggttcctttgctcttgccaccttagaacatgccctgtcccaggtcagacaccaaagattcatagttaatcttacagcctttatagtctcagccatagtcatcctagcaactgctagttttgctgtagcatctattactgaatcagtacaaatagctgcttttgtagataacttggccagaaatgtgtctaatgaacttctcttacagcagggtacaaatcaaaaggttcttgcacatctgcaagccctcgaggctgccttggaacatgtaggggagtgacaagatgcgctggcattctgacagcaattaaactgtgactgggagcataagcatatctgtgtcacctctctaccatggaaccaatcaatacatagttgggatgaggtgaaacaacacctcggggtgaccttacatgataatttaacagcagacgtaaagcaacttaaaactaaaattctagaatccctaaacgccatagatctacatgtccaacaaacagttatatggaaggatgtgcaagaacatctctcctggatagaccctcactccttgattggaaaaaaatattactaattatactcatgtttgtcttatgttatttactaattctaggatgcaaagccggaatacgagcagtaatcgctacgcctgacaaacctgctgctgtgcacatctgtactcttcaatcaacaaaacctgatgcaaaaaacaaaagggggagatgtaggagatcagtcagggtggtgggaaaagttataaggagagacgcaaaccttcttggaagtccaggaggttttgcaaagcttcgggagagaataaaggctgaaggcagctaaattctcttaccctgacgctaagggcaagaagtaggtaacaaaggagtgtaaaggaatttatctagacgagttttatttacttttgcagacctttgatcatcctattgcgcgcaggactgctcccaaggcggtgggggtgacaattacctacagattgtgttggctccaggcctttgtcattaaatctgtactgaataaatacaagcggctccagcttatcagggctgcattctctctttggtgtctctaaggccgaacagtcccctagccgcactcatgcaaaatacctgtgtctgtgtacttttttcatccgtcgctcagcctgagtctgcaggtcagacttggca

SEQ ID NO: 456 - DNA, 303 bp, Homo sapiens
tcagtggccggttcctgccttaactgatgacattaccttgtgacattccttctcctggacaatgaatatcagaagctccccaccgagcaccttgtaacccccgcccctgccagcaagagaacaaccccctttaactgtaattttccactacctacccaaatcctataaaactgcctcacccttgtctatctccctttgctgactccttttttggactcagtccgcctgcacccaggcgattaaaaagctttattgctcacacaaagcctgtttgatggtctctctccacatggacgtgtgtga

SEQ ID NO: 457 - DNA, 956 bp, Homo sapiens
gtggggaaaagcaagagagatcagattgtcactgtgtctgtgtagaaagtagaagacatgggagactccattttgttctgtactaagaaaaattattctgccttgagattctgttaatccataaccttacccccaaccccgtgctctctgaaacatgtgctgtgtcaactcagagttaaatggattaagggcggtgcaagatgtgctttgttaaacagatgcttgaaggcagcacgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaggggaaagacctgaccgtcccccagcccgacacccgtaaagggtctgtgctgaggaggattagtataagaggaaggcatgcctcttgcagttgagacaagaggaaggcatctgtctcctgcccgtccctgggcaatggaatgtctcagtataaaacccgattgtacgttctatctactgagatagggaaaaaccgccttagggctggaggtgggacatgtgggcagcaatactgctttgtaaagcattgagatgtttacgtgtatgcatatctaaaagcacagcacttaatcctttaccttgtctatgatgcaaagacctttgttcacgtgtttgtctgctgaccctctccccacaattgtcttgtgaccctgacacatccccctctcggagaaacacccacgaatgatgaataaatactaagggaactcagaggctggcgggatcctccatatgctgaatgctggttccccgggtccccttatttctttgtctctgtgtctttttctttcctaagtctctcgtcccaccttacgagaaacacccacaggtgtggaggggcaacccaccccttca

SEQ ID NO: 458 - DNA, 4578 bp, Homo sapiens
gtcaggcctctgagcctaagctaagccatcatatcccctgtgacctgcccgtacacatccagatggccggttccagccttaactgatgacattccaccacaaaagtgaaaatgacctgttcctgccttaactgatgacattatcttgtgaaattccttctcctggctcatcctggctcaaaagctcccctactgagcaccctgtgacccccacttctgcccgccagagaacaacccccctttttcctttacctacccaaatcctataaaatggccccaccccatctcccttcactgactctctttttagactcagcccgcctgcacccaggtgattaaaagctttattgctcacacaaagcctgtttagtagtctcttcacacggacacacatgaaatttggtgctgtgactcggattgggggacctcccttgggagatcaatcccctgtcctcctgctctttgctctgtgagaaagatccacctatcaggtcctcataccgaccagcccaagaaacatctcactaatttcaaatccggtaagtggcctctttttactctcttctccaacctctctcactatccctcaatctctttcgcctttcaatcttggcgccacacttcaatctctcccttctcttaatttcaattactttcattttctggcagagacaaaggagacatgttttattcgtctccttttagccctcccccacctgcccagcaatttactcttaaaaaggtggctggagccaaaggcatagtcaaggttaatgctcctttttctttatcccaaatcagatagcgtttaggctctttatcatcaaatataaaaacccagcccagttcatggctcgtttggcagcaaccctgagatgctttacagccctagaccctaagaagtcaaaaggccgtcttattctcaatatacattttattacccaatctgctcccaacattaaataaaactccaaaaattaaattctgaccctcaaactccacaacaggacttaattaaccttgccttcaaagtgtacaatcacagaaaaaagttgcaattccttgcctccactgtgagacaaaccccagccatatctccagcacacaagaacttccaaacgcctgaactgcagcggccaggcattcctccagaacctcctcccccaggagcttgctacaagtgccaaaaatctggccaccaagccaaagaatagccgcagcccaggattcctcctaagccgtatcccatttgtgcaggatcccactagaaatcggactgttcaactcacctggcagccactcccagagcccctggaactctggcccaaggctctctgactgactccttcccagatcttctcggcttagcggctgaagactgacgctgcccgatcgcctcagaagccccctagaccatcacggatgccgagcttcaggtaactctcacagtggaaggtaagtccgtccccttcttaatcaatacggaggctacccactccacattaccttcttttcaaaggcctgtttcccttgcctccataactgttgtgggtactgatggccaggcttccaaacctcttaaaactccccaactctggtgccaacttacacaatactcttttaagcactcctttttagtatccccacctgcccagttcccttattaggctgagacacttttaactaaattatctgcttccctgactattcctggactacagctatatctcattgctacccttcccaatccaaagcctcctttgcatcctcctcttgtatccccccaccttaacacacaagtataagataactctaccccgtccttggcgaccgatcatgcactccttaccatctcattaaaacctaatcacccttaccccgctcaatgccaatatcccatcccacagcatgctttgaaaggattaaagcctgttatcactcgcttgctacagcatggccttttaaagcctataaactctccttacaattcccccattttacctgtcctaaaaccagacaaggtttacaagttagttcaggatctgcgccttatcaaccaaactgttttgcctatccaccctgtggtgcccaacccgtacactctattgtcctcaataccttcctccacaacccactattccgttcttaatcttaaagatgcttttttcactattcccctgcacccctcgtcccagcctctctttgctttcacctggactgaccctgacatccatcagtcccagcagattacctaggctgtactgccgcaaggcttcacagacagcccccattacttcagtcaagcccaaatttcatcctcatctgttacctatctcggcataattctcataaaagcacacatgctctccctgctgatcgtgtccgattaatctcccaaacctcaatcccttacaaaacaacaactcctttccttcctagacatagttactgcagtcagaattcctacacaagagccaggaccgcaccctgtagcctgtccaaacaacttggacttactgttttagcctagccctcatgtctgtgtgcagcagctgccgctgctttaatacttttagaggccctaaaaatcacaaactatgctcaactcactctacatttctcataacttccaaaatctgttttcttcctcacacctgatgcatatactttctgctccccggctccttcagctgtactcactctttgttaagtctcccacaattaccattgttcctggcccggacttcaatctggcctcccacattattcctgataccacacctgaacctcatgactgcatctctctgatctcctgacgttcaccccatttccccacatttccttcttccctgttcctcaccctgatcacacttagtttattaatggcagttccaccaggcctaatcgccacacaccagcaaaggcaggctatgctatagtacaagccactagcccgcctcttagaacctctcagttcctttccatcgtagaaatctatcctcaaagatataacttctcagtgttccatctgctattctactacttctcaaggattattgaggccctctcccttccctacacatcaagctccaggatttgcccccgcccaggactggcaaattagctttactcaacatgccccaagtcaggaaactaaaatacctcttagtctaagtagacactttcactagataagtagaggcctttcccacaaaggctaagaaggccaccacagtcatttcttcccttctgtcagacataattcctcagtttggccttctcacctctatacagtctgatagcagaccagcctttattagtcaaatcagccaagcattttttcaggcttagtattcagtgaaacctttatatcccttacagtcctcagtcttcaagaaaagtagaacagactaatagtctttcaaaaacacacctcaccaagctcagctaccaacttaaaaaagactagacaatacttttatcactttcccttctcagaattcaggcctgtcctcagaatgctacaaagtacagcccatttaagctcctgtatagactctcctttttattaggccccagtctcattccagacaccagaccaacttagactgtgccccaaaaaaacttgtcatccctactatcttctgtctagtcatactcctattcaccgttctcaactactcatacatgccctgctcttgtttacactgctggtttacactgtttctccaagccatcacagctgatatctcctggtgctatccccaaactatcactcttaactcttaaagtaaataaataatctttgctggcaagactatgctgaatctccttaggcactctctaatcagatgtcctaggtcatcccaattcttagaccttttatacctgtttttctccttattccgtttttcaattcatacaaaaccatatccaggccatcaccaataattctaaatgacaaatatttcttctaacaaccccacaatatcaccccttaccacaaaatcttccttcagcttaatctctcccactataagttcccacaccgcccctaatcccgctcaaagcagccctgagaaacatcacccattatctctccataccaccccccaaaaatttttactgtcccaacactttaccactatttcgttttttcttattaatataagaagataggaatgtcaggcctctgagcccaagctaagccatcatatcccctgtgacctgcctgtacacatccagatgaccggttcctgccttaactgatgacattccaccacaaaagaagtgaaaatggcctgttcctgccttaactgatgacattatcttgtgaaattccttctcctggctcatactgactcgaaagctcccctactgagcaccttgtgaccctcactcctgcctgccagagaacaacccccctttttcctttacctacccaaatcctataaaacggccccacacctatctctcttcgctgactctttagactcagcccgcctgcacccaggtgattaaaagctttattgctcacacaaagcctgtttagtagtctcttcacatggacgcgcatgaa

SEQ ID NO: 459 - DNA, 1152 bp, Homo sapiens
tgagcccttaaaagggacaggaattgctcactcagggagctcggctcttcagacaggagtcttgccaatgctcctggttgaataaacctcttccttctttaactcagtgtctgaggagttttgtcttaggttcgtcctgctatatttcttggttccctgactgggaagtgaggtgattggcggatggttgcggcagctccttatgcagcttaagcctgccctgtggaacatccctgcgggggactccaaccagcccaagcaacgcagatcctgagagtgctcccgggtaggcatttgccctggtgggatgcctcaccagagcagtgtgtggcaggctcccatggaggatcaatgcagtggctaaacaccgggaaggaactagtacttggagtccggacatctgaaacttggtaagactagtctcgagaacttgcccactccatttgagtggaagcatggactgatcacccacagcgtgcctttatctgcactttggttttggttttggttttgacttggtttaaattgcttgacaggactggtcttgggaacttgcctactccatttgagtggaagcgtggcctgatcacccacggtgtgcctgtaccagcactctggtttttgtttttgacttgacttggattgtttgatactttggttttggttttgacctggcttggatttctggatactctgattttggttttgattttggtttggtgtaaactgcaaaagtgtgtgtgtgccctttttacccgttctttgttttgtggtgtgcgtgtggtttgagcatggtgttttgtctcgaagaagcatgggtcaggcacaaataagcccaccctactaggaactatgttaaaaaatttcaaaaaaggatttaaaggagactatggagtactatgacaccaggaaaatgtaaaactttgtgtaaaacagactggccagcattagaggtggattggccatcagaaagaagcctggataggtcccttgtttcaaaggtatggcacaaggtaacctgtaaagccagggcacccagaccagttcccttacacagatgcttggttacagctggttttagatctctccacagtggttgagagaactgcagcataagccaggctgagagagagagagagagagacagagaag

SEQ ID NO: 460 - DNA, 698 bp, Homo sapiens
gacatgacaaagttggcacatgtgcctgtactggtttaacacaggtttgatcctaggtctttatttaaaagatagtttccagctataagagaatttaaaaccctcactgcaagtgtattacataaaacactatcactctgtctcccaaagagactcaaagtaaaaataaaagcgagaactcccactaatttgtgaaaattctcaaaggaagggataaggagaccactactactcctgctgccctcctccctgccaccttgcctagttcataagacaggaggaaaagagagaaagcaaaaagttagaaagaaacaaaagtcagataaatagccagacaaccttggcaccaccacgtggccctaggagttaaaaaaaataataataataacatcaacccccgacctaaactacttgtgttatctgtaaattccagacattgtatgaaaaaagcattgcaaaactttctgttctgttagctgattcatgtagcccccagtcacgtttcccatgcttgctcaatttatcacgaccctttcacgtggacccttaaagtcgtaagcctttaaacaggccaagaatttcttttttggggagctcagctcttaagacgcaagtctgccgatgctcccggccgaataaacctctttcttctttaatccggtgtctgaggagttttgtctgtggcttgtcctgctaca

SEQ ID NO: 461 - DNA, 1235 bp, Homo sapiens
gagaaccaattttcgaagcatcaaaagcccatttaaatttggtaccagaaactgaggcaatcgcaggagtgactgatggcctcgcaaatcttaaccctgtcacttgggttaagaccatcggaagtactactattataaatttcgtattaatccttgtgtgcctgttttatctgttgttagtctgcaggtgtacccagcagctccgaagagacagcgaccatcgagaacaagccatgatgatgatggtggtttgtcgaaaaggaaatggggaaatgtggggaaaagagagatcagactgttactgtgtctgtgtagaaagaagtagacataagagactccattttgttctgtactaagaaaaattattctgccttgagatgctgttaatctgtaaccctacccccaaccctgtgctccctgaaacacgtgctgtgtcaactcagggttaaatggattaagggctgtgcaggatgtgctttgttaaacaaatgcttgaaggcagcatgcttgttaagagtcatcatcactccctaatctcaagtacccagagacaatacgctgcggaaggccgcagggacctctgcctaggaaagccaggtattgtccaaggtttctccccatgtgatagtctgaaatatgctggccgggaaagacctgaccgtcccccagcccaacacccgtaaagggtctgtgctgaggaggattagtaaaagaggaaggaaggcctctttgcagttgagataagaggaaggcatctgtctcctgctcgtccctgggcaatgggatgtctcggtgtaaaacccgattgtatgttccatctactgagatggggaaaaccgccttagggctggatgtgggacatgctggcagcaatactgctctttaaggcattgagatgtttatgtgtatgcacatcaaaagcacagcacttttttctttaccttgtttatgatgcggagacgtttgttcacatgttttcctgctgaccttctctccactattaccctattgtcctgccacatccccctctccgagaaacgcccaataatgatcaataaatactgagggaactcagagactggtgccggtgcgggtccactgtatgctgagcgccacttccctaagcccacttttctttctctatactttgtctctgtgtctccttcttttcttaagtctctcattccacctgacaagaaatgcccacaagtgtggaggggcaggccaccccttca

SEQ ID NO: 462 - DNA, 994 bp, Homo sapiens
gtggggaaaagaaagagagatcagattgttactgtgtctatgtagaaaaggaagacataagaaactccattttgatctgtacaaagaaaaattgtttctgctttgagatgctgttaatctgtaactttagccccaaccctgtgctcacagaaacatgtgctgtattgaatccaggtttaagggatttagggctgtgcaggatgtgccttgttaacaatatgttcgcagacagtatgcttggtaaaagttactgccattctccattctctattaaccagggacacgatgcactgcggaaagccgcagggacctctgcccaagaaagcctgggtattgtccaaggtttcccccgactgagacagcctgagatatggcctcgtgggaagggaaagacctaacggtcccccagcccaacacctaagacccataaagggtctgggctgaggaggattagtaaaagaggaaggcctctttgtggttgagataagaggaaggactctgtttgccgcacgtccctgggagcagaatgtctcagtataaagccaactgtttgttctattctgagataggagaaaactgccctgtggctggaggcgagatatgctggcaacaatactgctctgttactctttgctacactgagatgtttgggtaaagagaaacatgcacatccaggcacagtaccttcccttgaacttatttatgatgcagattccattactcacatgttttcctgctgactttctccccaccatcaccctgttctcctgctgcaccccccttgcaaaaatagtgaaaacagtaatcaataaatactgagggaactcggagaccggtgccagtgcaggtcctcacatgctgagtgtgccagttcccgggcccactgttcttgctctatactttgtctctgtgtcttatttcttttctaattttctcagtctctcatcccacctgacgagaaatactcacaggtgtggaggggcaggcccgcttc

SEQ ID NO: 463 - DNA, 5934 bp, Homo sapiens
gtcagggctctgagcccaagccaagccatcgcatcccctgtgacttgcatgtatacgcccagatggcctgaagtaactgaagaatcacaaaagaagtgaaaaggccctgccctgccttaattgatgacattccaccattgtgatttgttcctgccccaccttaactgagtgattaaccctgtgaatttccttctcctggctcagaagctcccccactgagcaccttgtgacccccgcccctgcccaccagagaacaaccccctttgactgtaattttccattaccttcccaaatcctataaaatggccccacccctatctcccttggctgactctcttttcagactcagcccacctgcacccaggtgaaataaacagctttattgctcacacaaagcctgtttggtggtctcttcacatggacgcgcatgaaatttggtgccgtgacttggatcaggggacctcccttgggagatcagtcccctcctcctgctctttgctccatgagaaagatccacctatgacctcaggtcctcagactgaccagcccaagaaacatctcaccaatttcaaatctggtaagcggcctctttttactctcttctccaacttccctcactatccctcaacttctttctcctttcaatcttggcgccacacttcaatctctcccttctcttaatttcaattcctttcattttctggtagagataaaggagacatgttttatccgtggacccaaaactctggcgccagtcatggactgggaaggcagccttcccttggtgtttaatcattgcagggacgcctttctgattattcatccacgtttcaaaggtgtcagaccacgcagggacgcctgccttggtccttcacccttagtggcaagtcccacttttctgggggaggggcaagtaccccaaccccttctctccatgtctctaccccttctctgcttttctgggggaggggcaagtacccctcaaccccttctccttcacccttagcggcaagtcccgcttttctgggggaggggcaagtaccccaaccccttctcttggtgtctctatcccttctctgcttttctgggggaggggcaagtaccccaaccctttctctctgtgtctctaccccttctctgcttttctgggggaggggcaagtaccccaacaccttctctccgtgtctttaccccttctctgcttttcttggggaggggcaagtacccctcaaccccttctccttcaccctttgcggcaagtcccgcttttctgggggaggggcaagtacccctcaactccttctccttcaccgttagcagcaagtcccgcttttctagggggcaagaacccccaatccgttattcccacaccccgacctcttatctctgtgccccaatcccttatttctgtgccccaaccctttctctgcttttctgggaggcaacaaaccctcactccttctccgtgtctctactcttttctctgggcttgcctccttcactatgggcaagcttccaccttccattcctccttcttctcccttagcctgtattcttaagaacttcagacctcttcagctctcacctgacctgaaatctaagcgtctttttttcttctgcaatgccgcttgaccccaatacaaactggacagtagttccaaatagctggaaaatggcactttcagtttttccatcctgcaagatctaaataattcttgtcgtaaaatgggcaaatggtctgaggtgcctgatgtccaggcattcttttacacatcagtcccttcctagtctctgtgcccagtgcaactcatcccaaatcttccttctttccctcccacctgtcccctcagtcccaaccccaagcatcgctgagtctttctaatcttccttttctacagacccatctgacctctcccctcctcgccaggccaagctaggtcccaattcttcctcagcctccgctcctccaccctgtaatctttttatcgcctcccctcctcacacctggtctggcttacagtttcgttcagtgactagcccttccccacctgcccagcaatttattcttaaaaaggtggctggagctaaaggcatagtcaaggttaatgctcctttttctttatcccaaatcagatagcgtctaggctctttttcatcaaatataaaaatccagcccagttcatgactcgtttggcagcaaccctgagacgctttacagccctagaccctaaaaggtcaaaaggccatcttattctcaatatacattttattgcccaatctgctcccgacattaaataaaactccaaaaattggaatctggccctcaaaccccacaacaggacttaattaacctcaccttcaaggtgtgcaataacagaaaaaagttgcaattccttgcctacactgtgagacaaacctcagccacatctccagcacacaagaacttccaaacacctgaactgcagcagccaggcattcctccagaacctcctcccccaggagcttgctacacatgctggaaatctgccactgggccaaggaatgcccacagcacggtattcctcctaagccacgtcccatctgtgtgggaccccaccgaaaatcggactgttcatctcacctggcagccactcccagagcccctggaactctggcccaaggctctctgactgactccttcccagatcttctcggcttagcggctgaagactgacactgcccgatcacctcggaagccccctaacccatcacagacgctgagatttgggtaactctcacggtggaaggtaagcccgtccccttcttaatacagaggctacccattccacattaccttctttttaagggcctgtttcccttgcctccataactgttgtgggtattgacggccaggcttctaaacctcttaaaactccccaactctggtgccaacttagacaatactcttttaagcactcctttttagttatccccacttgcccagttcccttattaggctgagacactttaactaaattatctgcttccctgactattcctggactacagctatatctcattgccacccttcttcccaatccaaagcctactttgcgtcctcctcttgtatccccccaccttaacacagaagtataagatacctctactccctccttggcaaccgatcatgcaccccttaccatctcattaaaacctaatcacccttaccccgctcaatgtcaagatcccatcccacagcacactttaaaaggattaaagcctgttatcactcgcctgctatagcatggccttttaaagcctataaacgcttcttaccattcccccattttacctgtcctaaaaccagacaagacttacaagttagttcagaatctgcgccttatcaaccaaattgttttgcctatccaccccgtggtgccaaacccatatactctcctatcctcaatacctccctctactacccattattctgttctagatctcaaacatgctttctttactattcctttgcacccttcatcccagcctctccttgctttcacttagactgaccctgacacccattaggctcagcaaattaccaaggctgtactgccgcaaggcttcacagacagcccccattacttcagtcaagcccaaatttcatcctcatctgttacctatctcggcataattctcataaaaacacacatgctctccctgctgatcgtgtccgattaatctcccaaacctcaatcccttacaaaacaacaactcctttccttcctaggcatggttagtgcggtcagaattcttacacaagagccagcaccgcaccctgcagcctttctgtccaaacaacttgaccttactgttttagcctagccctcatgtctgcatgcagcggctgccactgctttaatacttttagaggccctcaaaatcacaaactatgctcaactcactctctacatttctcataacttccaaaatctattttcttcctcatacctgacgcatatactttctgctccccggctccttcagctgtactcactctttgttaagtcccacaattaccattgttcatggccaggacttcaatccagcctcccacattattccagataccacacctgatcttcatgactgcatctgtctgatccacctgatgttcatcccatttccccacatttccttcttccctgcttctcaccctgatcacgcttgatttactgatggcagttccaccaggcctaatcaccatacaccagcaaaggcaggctatgctatagtacaagccactagcctgcctcttagaacctttcatttcctttccatcatagaaatctatcctcaaggaaataacttctcagtgttccatctgctattctatctgctattctactactcctcaaggattattcaggccccctcccttccctacacatcaagctcgaggatttgtccctgcccaggactggcaaattagctttactcaacatgccctgagtcagataactaaaatacctcttagtctaagtagacactttcactagataggtagaggcctttcctacagggtctgagaaggctaccgcagtcatttcttcccttctgtcagacataattcctcagtttagccttcccacctctatacagtctgataacagaccaacctttattagtcaaatcagccaagcattttttcaggctcttagtattcagtgacagactaatggtctattaaaaacacacctcaccaagctcagccaccaacttaaaaaggactggacaatacttttaccactttcccttctcagaagtcagacctgtcctcagaatgctacaaggtacagcccatttaagctcctgtatagatgctcctttttattaggccccagtctcattccagacaccagaccaacttagactgtgcccccaaataacttgtcatccctactatcttctctctagtcatactcctattcaccgttctcaactactcatacatgccctgctcttgtttacactgctggtttacactgtttctccaagccatcacagctgatatctccttgtgctatccccaaactgccactcttaactcttgaagtaaataaataatctttgctggcaggactatgacgaagctctgtaggcactctctaattagatgtcctaggtcctcccaattcttagtccttttatacctgtttttctccttctcttattccatttagtttttcaattcatacaaaaccgtatccaggccatcaccaatcattctatacgacaaatgtttcttctaacaaccccacaatatcaccccttaccacaaaatcttccttcagcttaatctctcccactctaggttcccacaccacccctaatcccgcttgaaggagccctgagaaacatcgcccattctctctccataccgccccccaaaaattgtcgccgacccaacgcttcaacactattttgttttatttttcttattaatataagaaggcaggaatgtcaggcctctgagcccaagccaggtcattgcatcccctgtgacttgcacatatatgcccagatggcctgaagtaactgaagaatcacaaaagaagtgaaaaggccctgccccgccttaactgatgacattccaccattgtgatttgttcctgccccaccttaactgagtgattaaccctgtgaatttccttctcctggctcagaagctcccccactgagcaccttgtgacccccgcccctgcccaccagagaacaaccccctttgactgtaattttccattacctttccaaatcctataaaatggccccaccgctatctcccttggctgactctcttttcggactcagcccacctgcacccaggtgaaataaacagctttattgctcacacaaagcctgtttggtggtctcttcacacggatgcgcatgaaa

SEQ ID NO: 464 - DNA, 2297 bp, Homo sapiens
agaccactactactcctgctgccctcctccccccaccttgcctagttcacaagacaggaggagataaaaagcaaaaagttggaaaaaaacaaaagtaagataaatagccagacaaccttggcaccaccacctggccctaggagttaaaaaaagtaataatagtaacatcaacccctgacctaaactacctgtgttatctgtaaattccagacactgtatgaaaaaagcgctgtaaaactttttgttctgttagctgatgcatgtagcctccagtcacatttcccacgcttgctcgatttatcacgaccctttcacatggaccccttaaagttgtaagcctttaaaaaggccaagaatttctttttcggagagctcggctcttaagacatgagtctgctgatgctcccggccgaataaaaacctcttccttctttaattcggtgtctgaggagtttcgtctgtggctcgtcctgctacatttcttggttccctgaccgggaaatgaggtgattaactgacggtcgaggtagccccttaggcagcttatgcatgctctgtagagcatccctgtgggggactccggcttgagcaatgcggatcctgagagtgctcccgggtaggcatttgccccagtggaacgccttgccagagcagcgcgtggcaggccccggtggaggatcaacgcagtggctgaacaccgggaaggaacaggcacttggagtccggacatctgaaacttggtaagactggtctttggaacttgcccactccgtttgagtggaagcgtggcctgatcacccacagcgtgtctgtactggcactttggtttttgtttttgacttgacttgaattgcttgatactttggttttaaccttgattttgacttgacttgaattgcttgataaacaggcatgcctttattggtactttggttttggttctgattttgacttggcataaattgcttgacgaacaggtgtgcctttaacaacactttggttttagttttgattttgatttagtgtgaattagacgagtgagtgaccttttaccctttccttcttgtagtgtgaattttttttgtttcaagagaaaaataggtcagacacaaagtaagcccactccgctaggaactatgttaaaaaatttcaaaaagaaaaataaaaggaaagtcatcaaagcatcaaaacttactctattaaaatgcatgttacagaaccttaggaaaggttctgtgggagattatagagttaagttaaccccctagaggttaagaactctgtgtgaattagaattgccctcttttggtgttagatggcccaccgaaggaactatagacagggaactattggccatgtatttaaggtggtgacaggggtcagagggcagccagtgtacctagatcaaattcctttatattgactcatggttaaatataatataggcaaaaccagcataaatttagccctgttgaacagcttattgcaaaaaagccaaaagtaaaagagcagcttcgccggcagacagagttaaaaagggagtcccagaaacagcaagagaagccagttttgcgggagccgccagagataacagaaattctttctccatatatcccagcctaccccgctttactgaggccaacaaccccctcagaaatgagattcaggagctaacacgctccaggttttaccttgaaggggaggatcggagcttcgagagaccaaggaaggaaatcaagatagtcaagtgggccatctcagatctgagaggctatgcaaatgcctctcagggagacacgaggacctgtctattataatgaccaggcccacatccggggggttgggggggacaacagactttcatctatcagcccttttcaaccattgatctactaaactggaaacaccctgaacccaccaccttgctcccggcagctaaagccctgtcgagcataactgtgtagaggtgttggactcaaatttactctagcagacctaacctccaggaccagccttgggcatcaatagactgggagctatacgtggacgggaacagcttcatcaacccccaaggagagagaggtgcagaatatgcggtggtaaccctggacactgttgttaagctgagctcattgctttaattcgggccttagaactcagtgaaggtaagacttgtaaacatttacactgactctgggtatgcctgtttaaccctccaagtgcataaaaaattgtataaagaaaagagcctgttaaactctagaaaaaagggaaaaaaagacccagagaatgcaatt

SEQ ID NO: 465 - DNA, 67 bp, Homo sapiens
atatggacagcccaccccaagggaagaatcagaggagaagggacacaagaccccagaaacacacaaa

SEQ ID NO: 466 - DNA, 1169 bp, Homo sapiens
cccctttgggtcccctccctttgtatgggaactctgttttcactctatttcactctattaaatcttgcaactgcactcttctggtctatgtttgttatggctggagctgagcttttgctcgccctctaccactgctgtttgccgctgtcgcagacccgccgctgactcccatcccgctgctgactcccatccctccggatctggcagggtgtctgctgtgctcctgatccagtgagactcccattgccactcccgatcgtgctaaaggcttgccattgttcctgcatggctaagtgcctgggttcgtcctaatcaagttgaacaccagtcactgggttccacggttctcttccgtgacccacagcttctaatagagctgtaacactcaccccatggcccaagattccattccttggaatcggtgaggctgagaaccccaggtcagagaacactaggcttgccaccatcctggaagcggcccgccatcatcttagaagcggctggccaccatcttgggagctctgtgagcaaggacccccggtaacattttggtgaccacgaaggggcatccaaagcgtttgtctcttccagaattgaaactgtaaaactacaaatcattcttcaaatggagccccagatgcagtctatgactaagatccaccgcggacccctggaacagcctgctagcccatgctccgatgttaatgacatcgaaggcaaccctcccgaggaaatctcaactgcacaacccctactacgccccaattcagcaggaagcagttagggcggtcatcggccaatctccccaacagcacttgggttttcctgttgagaagggggactgagagacaggactagctggatttcctaggccaactaagaatccctgagcctagctgggaatgtgaccgcatccacctttaaacacggggcttgcaacttagctcacacccaaccaatcagagagctcactaaaatgctaattaggcaaaaacaggaggtaaagaaatagccaatcatctcttgcctgagagcacagcgggagggacaaggatcaggatataaacccaggcattagagccagcaacggccacccactttgggtcccctccctttgtgtgggagctgtgttttcactctatttcactctatgaaatcttgcaactgca

SEQ ID NO: 467 - DNA, 960 bp, Homo sapiens
gtggggaaaagcaagagagatcagattgttactgtgtctgtatagaaagaagtagacataggagactccattttattctgtactaagaaaaattcttctgccttgagattctgttaatctatgaccctacccccaacccggtgctctctgaaacatgtgctgtgtcaaactcagggttaaatggattaagggttgtgcaagatgtgctttgttaaacagatgcttgaaggcagcttgctccttaagagtcatcaccactccctaatctcaagtacccagggacacaaacactgcggaaggacccctgcctaggaaagccaggtattgtccaaggtttctccccatgtgatagtctgaaatatggccttgtgggaagggaaagacctgaccgtcccccagcccgacacccgtaaagggtctgtgctgaggaggattagtataagaggaaggcaagcctcttgcagttgagacaagaggaaggcatctgtctcctgcccgtccctgggcaatggaatgtctcagtataaaacccgattgtaggttccatctactgagatagggaaaaaccgccttagggctggaggtgggacgtgcgggcagcaatactgctttgtaaagcattgagatgtttctgtgtatgcatatctaaaagcacagtacttaatcctttaccttgtctatgttgcaaagacctttgttcacgtgtttgtctgctgaccctctccccactattgtcttgtgaccctgacacatccccctctcggagaaacacccatgaatgatcaataaatactaagggaactcagaggctggcgggatcctccatatgctgaacgctggttccctgggtccccttatttctttctctatactttgtatctgtgtctttttcttttccaagtctctcgttccaccttacgagaaacacccacaggtgtggaggggcaacccaccccttca

SEQ ID NO: 468 - DNA, 387 bp, Homo sapiens
gtcaggcctctgagcccaagctaagccatcatatccctgtgacctgcacgtatacatccagatggcctgaagcaaatgaagaatcacaaaagaagtgaaaatggccagttcctgccttaactgatgacattaccttgtgaaattccttctcctggctcagaagctcccccactaagcaccttgtgactcccacccctgcccgccgaagaacaaccccctttgactgtaattttccattacctacccaaatcctacaaaatggccccacccctatctcccttcgctgactctcttttcagactcagcttgcctgcacccaggtgaaataaacagacttgttgctcacaaaaagcctgtttggtggtctcttcacacggatgcgtgtga

SEQ ID NO: 469 - DNA, 6143 bp, Homo sapiens
gtcaggcctctgagcccaagctaagccatcatatcctctgtgacctgcatgtatacatccagatggcctgaagtaactgaagaatcacaaaagaagtgaaaatggcctgttcctgccttaactgatgacattaccttgtgaaattccttctcctggctcatcctggctcaaaagctcccctgctgagcaccttgtgacccccactcctgccagccagagaacaaccccctttgactgtaattttcctttacctacccaaatcctataaaacagccccacccctatctcccttcactgactctcttttcagactcagcccacctgcacccaggtaaaataaatggccttgttgctcacacaaagcctgtttggtggtctcttcacacggacacaagtgaaatttggtgccctgactcggatcgggggacctcccttgggagctcaatcccctgtcctcctgctgtttgctctgtgagaaagatccatctacaaccttgggtcctcagaccaaccagcccaaggaacatctcaccaattttaaatcgggtaagcggcctctttttactctcttctctaacctctctgactatccctcaacctctttctcctttcaatcttggcgccatctttcaatctctgccttctcttaatttcagttcctttccttttctggtagagacaggagacgcattttatccatgaacccaaaactccggcaccactcatggactcaggacgacagtcttcccttggtgtttaatcacgcggggatgcctgcctgattattcacccacgtttcagaggtgtctgaccacatggggatgcctgccttggtccttcacccttagcggcaagcaccacttttctggggggcaagcaccccccgaccccttctctccatgtctctaccctctcttttctgccttggtccttcacccttagtggcaagcaccacttttctggagggcaagcacccccctactccttctctccatgtctctaccccttttccactttcctggggggcaagcaccccccaccccttctttccatgtctctagcctctcttttctctgggcttgcctccttcactatggacaaccttccaccctccattcctccctcttctcccttagcctgtgttctcaaaaacttaaaacctcttcaactcacacctgatctaaaacctaaatgccttattttcttctgcaacactacttggccccaatacaaacttgacaatggctctaaatggccagaaaatggcactttcaatttttccatcctacaagatctagataattcttgtcataaaatgggcaaacggtctgaggtgcctgacgtccaggcattcttttacacattggtccctccctagtctctgttcccaatgcaactcatcacaaatcttccttctttccctccgcctgtcccctcagtcccaatcccaagtgttgctgagtctttccaatcttcctttttttttttttttttttacagacccatctgacctctcccctcctccccaggctgctccttgccaggccgcgccaggttccaattcttcctcagcctccgctcctccaccctataatccttttatcaactcccctcctcacacctggtcccgcttacagtttcattccatgactagccctccccaacctgcccagcaatttcctcttaaaaaggtggctggagctgaaggcatagtcaaggttaatgctcctttttctttacccgacctctcccaaatcagttagcgtttaggctctttttcatcaaatatgaaaaacccagcccagttcttggcccctttagcagcaacccttagactctttacagccctagactcggaagggtcagaagtccatctcattctaaatatgcattttatcacccagccagctcctgacattaaataaaactccaaaaattaaataaattccagccctcaaaccccacaacaggacttaattaacctcactttcaaggtgtacaataatacagtagaggcagccaagtagcaatgtatttctgagttgcaattccttacctccactgtgagacaaaccccagccacatctctagcacacaggagctccaaacgcctgaaccgcagcttccaggggttcctccagaacctcctcccccaggagcttgcttcaagtgccagaaatctggtcactgggccaaggaatgcccgcagcctgggattcctcctaagctgtgtcccatctgtacgggaccccactggatatcagactctccaacttgcccagcagccactcccagagcccctggaactctggcccaaggctctctgactgactccttcccagatctgcttggcttagcggctgaagactgacgcagccccgtcacctcggaagccccctggaccatcacggacgccgagctttgggtaactcttacagtggaaggtaagtccatccccttcttaatcaatacagaggctacacactccacattaccttttcaagggcctgtttcccttgtctccataactgttgtgggtattgacaaccaggcttctaaacctcttaaaactccccaactctggtgccaacttggataacattctttaatgcactgctttttagttaatcccacctgcccagctcccttattaggtctaggcattttaactaaattatctgcttccctgactattcctgggctacagccacacctcattgccaccttttcccccagttcaaagcttccttcacatcctccccttgtatctccccaccttaccccacaagtataggacacctctactccctccttggcgaccaatcatgcaccacttaccatcccattaaaacctaatcacccttaccccactcaatgccaatatcccatcccacagcccactttaaaaggattaaagcctgttatcactcgcctgctacagcatgggcttctgaaacctgtatactctccatacaattcccctattttacatgtccaaaaaccggacaagtcttacaagttagttcaggatctgcgccttatcaatcaaattgttttgcctatccaccccgtggtgccaaacccatgtactctcctatcctcaatacctccctccacaacccattattctgttatggatctcaaacatgctttctttactattcctttgcacccttcatcccagcctctctttgctttcacttggactgaccctgacacccattaggctcagcaaattacctgggctgtactgccacaaggcttcacagataggctcagtcaagcccaaatttcttcctcatctgttacatatcttggcataattctcataaaaacacacgtgctctccctgctgatcatgtccgactaatctcccaaaccccaatcccttctacaaaacaacaactcctttccttcctaggcatggttagtgcagtcagaattcttacacaagagccaggactgtgccctgtagcctttttatccaaacaacttgaccttactgttttagcctagtcctcatgtctgtgtgcagcagctgccactgccttaatacttttagaggacctcaaaatcacaaactatgctcaactcactctctaaaattctcataacttccaaaatctattttcttcctcccacatgatgcatatactttcttctccccagctccttcagctatacttactcattgttgaatctcccacagttccattgttcctggcccagacttcaatccggcctcccacattattcctgataccacacctgacccccatgactgtatctctctgatccacctgacattcactccatttccccatatttccttctttcctgttcactattggtttattgataaaccctgaacactattggtttattgatggcagctccaccaggcctaatcgccacttaccagcaaaggcaggctatgctgtagtatcttccatacctatcattgaggctacctctctgcccccctccactacctctcaaaaagccaaactcattgccttaactcaagccctcgctcttacaaaaggactatgcatcaatatttatactgactctaaatatgccttccatatcctgcaccaccatgctgttatatgggcagaaagaaatttcctcactatgcaagggtcctctatcattaatgcctctttaataaaaactcttctcaaagctgctttacttccaaaggaagctggagtcactcactgcaagggccatcaaaagtcatcagattccatcactcaggacaatgcttatgctgataaggtagctaaaaaagcagctagcgttccaacttctatccctcacggcagtttttctccttctcatctggccactcccacctactctcccactgaaacttccacctatcgatctcttcctacacaaggcaaatggttcttggaccaaggaaaatatctccttccagcctcacaggcccattctattctgtcatcatttcataacctcttccatggaggttacaagctgctagcccacctcttagaacctctcatttcctttcaatcatggaaatctaaccttaaggaaatcacttctcagtgttccatctgctattctactactcctcagggattgttcaggcccccccacttccctacacatcaagctcggggatttgtccccacccaggactggcaaattgactttactcacatgcctcagtcaggaaactaaaatacctcttggtctgggtagacactttcactgggtgggtagaggcttttcccacagggtctgagaaggccactgcagtcatttcttcccttctgtcagacataattcctcagttggccttcccacctctatacagtctgataacagaccagcctttattagtcaaatcactcaagcagtttctcaggctgttggtattcagtgaaacctttatatcccttaccatcctcagtcttcaggaaaggtagaacagactaatggtcttttaaaaacacacctcatcaagctcagccaccaacttaaaaagtaccggacaatacttttaccacttgcccttatcagaattcaggcctgtcctcagaatgctacagggtacagcccatttgagctcctgtatagacgctcctttttattaggccccagtctcattccagacaccagaccaacttagactgtgccccgaaaaacttgtcatccctactatcttctgtctggtcacactcctattcactgttctcaactactcatacaagccctgctcttgtttatgctgccggtttacactgtttctccaagccatcacatctgatatctcctggtgctatctccaaactgccactcttaactcgctcttaaagtaaataaataatctttgctggcagggctatgctgaacctccttgggcactctctaattggatgtcctgggtcctcccaattcttagtcctttaatacctgtttttctcctcttattctgtttagtttttcaattcatacaaaaccgtatccaggccatcaccaataattctatatgacaaatgtttcttctaacaaccccacaatatcaccccttaccacaaaatcttccttcagcttaatctctcccactgtaggtccccacgctgccccaatcccactcaaagcagccctgagaaacatcgcccattatctctccagatcaccccccaaaattttcaccaccccaacacttcaacactattttgttttatttttcttattaatataagaagacaggaatgtcaggcctctgagcccaggctaagccatcatatcctctgtgacctgcatgtatacatccagatggcctgaagtaactgaagaatcacaaaagaagtgaaaatggtctgctcctgccttaactgatgacattaccttgtgaaattccttctcctggctcatcctggctcaaaagctcccccgctgagcaccttgtgacccccccccacccctgccagccagagaacaaccccctttgactgtaatcttcctttacctacccaaatcctataaaacagccccgcccctatctcccttcgctctcttctgattcagcccacctgcacccaggtgaaataaacagccttgttgctcacacaaagcctgtttagtggtctcttcacacggac

SEQ ID NO: 470 - DNA, 972 bp, Homo sapiens
gtggggaaaagaaagagagatcagattgttactgtgtctgtgtaggaagaagtagacataagagactccattttgttctgtactaagaaaaattgttttgccttgagacgctgttaatctgtaaccctacccccaaccctgtgctccctaagacatgggctgtgtcaactcagggttaaatggattaagggctgttcagggtgtgctttgttaaacaaatgcttgaaggcagcatgcttgttaagagtcatcaccactccctaatctcaagtacccagaggcacactacactgcggaagactgcagggtcctctgcctaggaaagccaggtattgtccaaggtttctccccatgtgatagtctgaaatacagcctcgtgggaagggaaagacctgactgtcccccagcccgacacccgtaaagggtctgtgctgaggaggattagtaaaagaggaaggaaggcctctttgcagttgagataagaggaaggcatctgtctccggctcgtccctgggcaatggaatgtctcggtgtaaagcccgattgtatattccatctactgagataggagaaaaccgccttaggactggaggtgggacatgctggcagcaatactgctctttaaggcattgagatgtttctgtatatgcacatcaaaagcacagcacttttttctttaccttgtttatgatgcagagacatttgttcacgtgtttacctgctgatcttctctccactattatcctattgtcctgccacatccccctctccggaaatgcccgataatgatcaataaatactaagggaactcagaggccagtgccggcatgggtcctccgtatgctgaacgccggtcccctgggcccatttttcttcctctgtactttgtctctgtgtctctttcttttccaagtctctccttccacctaatgagaaacgcccacaggtgtggaggggcaacccatcccttca

SEQ ID NO: 471 - DNA, 960 bp, Homo sapiens
gtggggaaaagaaagagagatcagactgttactgtgtctatgtagaaagaagtagacataagagactccattttgttctgtactaagagaaattcttctgccttgagatgctgttaatctgtaaccctagccccaaccctgtgcttgcagagacatgtgctgtgttgactcaaggtttaatggatttagggctatgcaggatgcactttgttaaaaaagtgcttgaaggcagtatgcttgttaaaagtcatcaccattctctaatctcaagtacccagggacacaataggctgccgaaggctgcagggacctctgcctaggaaagccaggtattgtccaaggtttctccccatatgatagcctgagatatggcctcctgggaacggaaagacttgaccgtcccctagcccgacacctgtaaagggcctgtgctgaggaggattagtaaaagaggaaggcctctttgcagttgagataagaggaaggcatctgtctcctgatcgtccctgggcaatggaatgtctcggtgtaaaacccgatcatatgttccatttactgagataggagaaaaccaccttagggctggaagtgagacatgctggcggcaatactgctctttaatgcaccaagatgtttgcatacgtgcacatcaaggcacagcacctttccttaaacttaattatggcacagagacctttgttcgcatgttttcctgctgaccctctccccactattaccctattgtcctgccacgtgcccctctccgagatggtagagataatgatcaataaatactgagggaactcagagaccagtgccagcgcgggtcctccgtatgctgagcgctggtcccctgggcccacttttctttctctatactttgtctcttcttttctcagtctctcgtcccacctgacaagaaaccctcccacaggtgtggaggggctggccaccccttca

SEQ ID NO: 472 - DNA, 487 bp, Homo sapiens
ttacggtgggtagctagtcaggtatgaacaaagcaggagatggctcccccaaacacacactaggagtgtcgggcaaccatcaggtgagatggtcaggcggttattaactctcttgctgaagtagtaattggtcacagctggcaccagggaacggcagtctcctaatagaaaacacctgaaactggtgagcagcagcttcccaataagatctcaggagttgggcaagtggggagaagtaatgcaagaccttggaagtatgccagtgtataaaacgccaagtcaaaagctcaagccacacatttatctttcaagtcgcccgcttggtcctcttccaagcgtacttccctttctttcattcctcctctaaagctttttaataaactttcactcttgctctaaaacgtgcctcaccctctccttctgcccctcagtcgaattctttcttctgaggaggcaagaattgaggttgctgcagacctgtacggat

SEQ ID NO: 473 - DNA, 994 bp, Homo sapiens
gtgggggaaagaaagagagatcagactgttactgtgtctatgtagaaaaaggaagacataagaaactccattttgatctgtactaagaaaaattcttctgtcttaagatactgttaatctgtaaccccagccccaaccctgtgcccgcagaaacatgtgctgtattgactcaagatttaatgtatttagggctgtacaggatgtgctttgttaaaaatgtctttgcagacagtatgcttggtaaaagtcatcgccattctccagtctcccgtacccagggacacaatgcactgcggaaagccgcagggacctcatgcccaagaaagcctgggtatcgtccaaggtttccccccactgagacagcctgagatatggcctcatgggaagggaaagacctgaccatcccccagcccgacacccataaagggtctgtgctgaggaggattagtgaaagaggaaggcctctttgcagttgagataagaggaaggtatctgtctcctgctcatcgctgggaatggaatgtctcggtgtaaaacctgatcatacattctatttactgagataggagaaaatcaccttatggctggaggtgagacatgctggcgacaatactgctctttacgacactgagatgtttgtgtaaagtcaaacataaatctgtcctacgtgcacatcaaggcacagcacctttccttaaacttatttatgacacaaagtcctttgctcacatgttttcctgctgaccctctccccaccattaccctgtagtcgtaccacatccccctcactgagatgaaagagatagtgatcaataaatactgagggaacttagagaccagtgccgggtgcgggtcctccgtatgctgagcgccggtcccctgggtccacctttcttcctctatactttgtctctgtgtcttatttcttttctcagtctctcatctccaccttgtgagaaacacccacaggtgtggaggggcaggcccccttcac

SEQ ID NO: 474 - DNA, 8449 bp, Homo sapiens
gtcaggcctctgagcccaagctaagccatcatatcccctgtgacctgcacgtatacatccatatggcctgaagcaactgaagatccacaaaagaagtgaaaatagccaattcctgccttaactgatgacatcccaccattcctgccccaccctaactaatcaattgactttgtgacaatactacctccccgcccttgtgataatgtactttgtgatattcccccacccttgtgaatgtactttgtacgatataccctccccacccttgagaaggtactttgtaatatgctcccctgcccttaagaaggtactttgtaatattctccccacccttgagaatatactttgtaagatccaccccctacctgcaaaaaattgctcctaactccactgcctatcccaaacctataagaactaatgataatcccaccaccctttgctgactcctttttccgactcagcccacctgcacccaggtgaaataaacagccttgttgctcacacaaagcgtgttgctggactctcttcacatggacgtgcgtgacatttggtgccgaaacctgggacaggaggactccttcgggagaccagtcccctgtcctcaccctctgtgaggagatccacctatgacctcaggtcctcagaccaactaacccaaggaacatctcaccaaattcaaatcgggtaagcggtcttttcactctcttctccaacctctctcgctatccctccacccttcaatctctcccttccttaatttcggttcctttccctttctggtagagacaggagatgcgttttatccatgaactcaaaactccggcgccggtcacggactcgggaagacagtcttcccttggtgtttaatcactgcggggatgcctgcctgattattcacccacatttcagaggtgtctgatcactgcagggatgcctgccttgatcctccaccttggtggcaagcaccacctcccctgggtggcaagtaccacccccccactctgtgtctctaccctctcttttctctcggcttgctgccttcactatgggcaaccttccaccctccattcctccttcttctcccttagcctgtgttcttaaaaacttaaaacctcttcaactcacacctgacctaaaacctaaatgccttattttatgctgcaatactgcttgaccccaatacaaactcagcaacggttccaaatagccagaaaacagcactttcgatttctccatcccacaagatctagataatgcttgtcgtaatatgggcaaatggtctgaggtgtctgatgtccaggcattcttttgcacatcagtccctccctagtctctgctcccaatgcgactcgtcccaaatctttcttttttctctcctgtctgttccttcagtctccaccccaagctctgagtcctttgaatcctccttttctacaaacccgtctgacctctcccctcctccccaggctgctccttgccaggccgagccaggtcccaattctccctcagcctccactcctctaccctataacccttctgtcacctcccctcctcacacccagtccagcttacagttttgttccgctactagccctcccccatctgcccaaaaatctcctcttagagaggtgactggagctgaaggcatagtcaaggttaatgcttctttttctttatctgacctctcccaaatcagttagggtttaggctctttttcattaaatataaaaacccagcccagtccatggcccgtttggcaacaacccttagacagtttaccaccctagacccagaggggccagaaggccgtattattcttgatatacattttattacccaatctgctcccccaacattagaaaaagctccaaaaattagattctggccctcaaaccccacaacgggacttaattaacctcgccttcaaggtgtacaataatagaaaagagttgcaattacttgcctccactgtgagaaaaacccaagccacatctccggtacataagaacttcaaaatgcctgaaacgcagcggccaggagttcctccaggacttcctcccccagaatcttgcttcatgtgctgaaaacctggccactggaccaaggaatgccagcagactgggatttctcctaagccatgtcccatctgtgcaggaccccactggaaatcagactgtccaacttgcctggcagccactcctagagtccctggaactctggcccaaggctgtctgactgacttctttccagatcttctcggcttagcggctgaagactgacgctgtccgatcgcctcaaaaacctcctggaccatcccggatgctttgggtaactcttacagtggagggtaagttcgtccccttcttaatcaatacagaggctacccactccacattaccttcttttcaagggcctgtttcccttgcctccataactgttgtgggtagtgacagccaggcttctaaacctcttaaaactccccaactctggtgccaacttggacaacatttttttttttttttgagatggagtcttggtctgttgcccaggctggagtgcagtggcgtgatctcagcgcactgcaagctctgcctcccgggttcacaccattctcttgcctcagcatcccgtgtagctgggactacaggcatctgccaccgcgcccggctaattttttgtatttttagtagagacgggggtttcactgtgttagccaggatggtctcgatctcctgacctcgtgatccacctgccttggcctcccaaagtgctgggattacaggcgtgagccactgcgcccagctgacaacattcttttatgcactctttttagttatccccacctgcccagttcccttattaggtcgaggcattttaactaaattacctgcttccctgactattcccaggctacagccacacttcattgcagcccttttccccagttcaaagcctccttcgcatcctccccttgtatctcctcaccttaatccacaagtatggaacacctctactccctccttggtgacctatcatgcaccccttaccattccattaaaacctaatcacccttaccccactcaatgccaatatcccatcccacagcatgctttaaaaggattaaagcctgttatcattcgcctgctacagcatggccttctaaagcctataaactctccttacaattcccccattttacctgtccaaaaaccagacaagtcttacaggttagttcaggatctgcatcttatcaaccaaattgtcttgcctattcaccccgtggttctaaacccatatactctcctatcctcagtacttccctccacaactcctccacaacccattattctgttctagatctcaaacttgctttatttactattaatttgcacccttcatcccagcctctcttcgctttcacttggactgaccctgacacccatcagtctcggcaacttacctagagtgtactgccgcaaggcttcatggacagtccccattacttcagtcaagctctttctcataatttactttctttccatccatctgcttctcaacttattaaatattttgatgaccttctactttatagcccctcctacaaatcttcccaacagaacaccctcctgctcctccaacatctattctcaaaaggacatcgcacatccccctccaaagctcaaatttcttccccatctgttacctacctgggcataattcttcatgaaaacttccgtgttctccctgccaatcatgtccagctgatctctcaaaccccaaccccttctacagaacaacaactcctttccttcctaggcaggattggatactttcacctttggatacctggttttgccatcctgactaaactcacaaaaggaaacctagctgaccccgtagatcctaaatcctttccccactcctctttccattccttaaaaacagcctgagaagctgctcccacactagctctccctaactcatcccaaccttttttcattagacacagccaaagtgcagggctgtgcagttggaattcttacacaagagccaggacaatgccctgtagcctttctgtccaaacaacttgaccttactgttttaggctggcccccacattattcctgataccacacctgacccccatgactgtatctctctgatccacctggcattcactgcatttccccatatttccttctttcctgtccctcaccctgatcacacttggtttattgatggtagttcttccaggcccaatcaccaatcaccatcaaaggcaggctatgctatagtgtcttccacatctatcactgagactactgctctgcccccctccactacctctcagcaagccaaactcattgccttaactcaggccctcactcttgcaaagggactacatgtcaatatttatactgactctaaatatgtcttccatatcctgcaccaccatgctgttatatgggctgaaagaggtttccttgctatgcaggggtcctccatcattaatgcctctttaataaaaactcttctcaaggccactttacttccaaaggaagctagagtcattcactgcaaaggccatcaaagggcctcagaccccattgctcaaggcaacaattatgctgataagacagctaaagaagcagccagtatacctacttctgtccctcactgccaggttttctctttctcatcagtcactcctacttactctcccactgaagtttccacctatcaatccctccccactcaaggcaaatggttcttggaccaaggaaaatacctccttccagcctcacaggcccattctattctgtcgtcatttcataacctcctccatgtaggttacaagccgctaacctgtctcttagaacctctcatttcctttccatcgtgcaaatctattctcaaggaaatcacttctcagtattccatctgctattctactactcctcagggatatctcaggccccctccctttcctacacatcaagctcagggatttgcccctgcccaggactggcaaattgactttactcacatgccctgagtcaggaaactaaaatacctctttgtctgggtagacactttcactggatgggtagaggcctttcccacagggtctgagaaggccaccacagtcatttcttcccttctgtcagacataattccttggtttggccttcccacctctatacagtccaataacggaccggccttttcttttttcctccaatttaaaacctttaattgaaaagtaaactttaatatcgaaaatgcaaacatggggaaggcagaaagatcacacacacaaggctgtcacttcacacttggagggttgcacagtggccaggcagaggcactcctcacttcccagatggtgggcagccaggcagaggtgctcctcacttcccagtcagttgggtggccgggcagatgggctcctagcttcccagaaggttggcggccaggaagaggtgctcctctcttcccagacagggcggcgaccagagagaggcactcctcacttgccagacagcgtggtagccaggcagaggcgctcctcacatcccagacggtgggggtggggagcctgggcagaggcgctcctcatttgctagacagggcggcagccgggcagaggtgctcctcactttccagatgggtggcagctgggcggcagctgggcagaggtgctcctcacttcccagacagtggggcagccaggcagaggtgctccgcccttcccagatggtgggcagccgggcagaggcgcttctcacatcctagacagggcggtggctggtcagaggcactcctcacttcccagatggcgggcagctgggcagaggtgcttctcatatcccagacggtgggcagcccggaccggcctttattagtcaaatcaaccaagcagtttgccaggctcttggtattcagtggaaccttcataccccttaccatcctcaatcttcaggaaaggtagaacagactaatggtcttctaaagacacacctcaccaaactcagccttcaacttaaaaaggactggacagtactttcactacttgcccttctcagaattcaggcctgtcctcgggatgctgcagggtgcagcccatttgagctcctgtatggatgctcctttttattaggccccagtctcattctagacaccagccctctagttgattatcttccagtcctccagcagactagacaggaaattcgccaggctgctaatcttctcttgcctactccagattcccagccatatgaagacaccctagctggacgatcagttcttgttaagaatctgaccccttaaactctacaaccttgatggactggaccctacttagtcatctatagtaccccaactgccgtccacctgcaggaccctccccttgggttcactgttccagaataaagctgtgtccgttggacagcctgatctctcctcttcctcctggaagttgcaagtactctcctctacttcccttaaactcacatttctgaagaacagtaataaccctgataagcctaatacatcctttcatttttattaggtctcttcttccttaccctactctttacaatagggctttacgcagtcaccccccactaattggactgcaccacaaaaacttgtcatccctactatcttctggctagtcatactcctattcaccattctaaactactcgtaaatgccctgcccttgtttacactgccagtttacacttttcctccaaaccatcgtagcggatatctcctggtactatccccaatcctccactcttgactccctcttggagtggatggatgatctttgctgacagggcacactccaatacttccaccctgatgaagtcctattctttacttttatactcacttttttttttttttttgagatggagtctcgctctgttgcccaggctggagtgcagtggtgcgatctcggctcactgcaagctctgcctcccgggttcatgccattctcctgcctgagcctcctgagtagctgggactataggcgcctgccaccacgcctggctaattctttgtatttttttagtagagatggggtttcatcatgttagccaagatggtcttgatctcctgacctcgtgatccacccacctcagcctcccaaagtgctgggattacaggcatgagccaccgcgcccagcctacttttatactcacttattctcattcctgttcttatgccaccctctactctccccagctatctctaccacactatcaatatcactcactctctcctagccgtttctaatccttctttaacaaacaattgctggctttgcctttctctttcctccaaaatcaccgaggcctcgacttactcattgctaaaaaaaggggactctgtatatttttaaatgaagagtgttgtttttacctaaatcaatctggcctggtgtatgacaacataaaaaaactcaaggatagagcccaaaaactcaccaaccaagcaaataattacactgaacccccttgggcactctctaattggatgtcctgggtcctcccaattcttagtcctttaatacctgtttttcgccttctcttattcagaccttgtgtcttccgttcagtttctcagttcatacaaaattgcatccaggccatcaccaatcattctatatgacaaatgctccttccaacaatcccacaatatcaccccttaccccaaaatctttcttcagtttaatctctcccactctaggttcccatgccacccctaatcccattcgaagcagccctgagaaacattgcccattatctctccataccacccccaaaaaacgttcgccaccccaacacttcaacaccattttgttgtgtttttcttattaatataagaagacaggaatgtcaggcctctgagcccaactaagccatcatatcccctgtgacctgcacgtatacatccatatggcctgaagcaactgaagatccacaaaagaagtgaaaatagccaattcctgccttaactgatgacattccaccattcctgccccaccctaactgatcaattgactttgtgacaatacaccctccccgcccttgtgataatgtactttgtgatattcccccacccttgtgaatgtactttgtacaatacaccctccccacccttgagaaggtactttgtaatatgctcccccacccttaagaaggtactttgtaatgttctccccaccctttgtactttgtaagatccaccccctgcctgcaaaaaattgctcctaactccactgcctatcccaaacctataagaactaatgataatcccaccaccctttgctgactgccttttggactcagcttgcctacacccaggtgaaataaacagccttgttgctcacacaaagcctgtttgtggactctcttcacacagacgcatgtga

SEQ ID NO: 475 - DNA, 5749 bp, Homo sapiens
gtcaggcctctgagcccaagccaagccatcgcatcccctgtgacttgcacgtatacgcccagatggcctgaagtaactgaagaatcacaaaagaagtgaaaagaccctgccctgccttaactgatgacattccaccattgtgatttgttcctgccccaccttaactgagtgattaaccctgtgaatttccttctcctggctcagaagctcccccactgagcaccttgtgacccccgcccctgcccaccagagaacaaccccctttgactgtaattttccattaccttcccaaatcctataaaatggccccacccctatctccctttgctgactctcttttcggactcatccggcctgcacccaggtgaaataaacagccatgttgctcacacaaagcctgtttggtggtctcttcacacggacgcgcatgaaatttggtgccatgactcagatcaggggacctcccttgggagatcaatcccctgtcctcctgttctttgctccgtgagaaagatgcacctacgacctcaggtcctcagaccgaccagcccaaggaacatatcaccaattttaaatcaggtaagcggtctcttcttactctcttctccaacgtctctcactgtccctcaaccactttctcctttccactcttcaatctctcccttctcttaatttcaattcctttcattttctgggagagacaaaggagacacgttttatccgtggacccaaaactccggcggcggtcacggactgggaaggtagccttcccttggtgtttaatcattgcagggacgcctctgattattcacccacgtttcaaaggtgtcagaccacgcacggacgcctgccttggtccttcacccttggcggcaagtctcgcttttctggggaaggggcaagtaccccaaccccttctctccttgtctctaccccttctctgctttcctggggcaggggcaagtacccctcaacctcttcttcacccttagctgctagtcccgctttcctagggggcaagaaccccccaatcgcttatttccacgccccaacctcttatctctgtgccacaatcgcttatttccgcgccccaacctcttatctctgcgccccaattgcttatttccgcgccccaacctcatctctgcgccccaatcccttatttccgcgccccaacctcttatctctgtgccccaatcccttatttccgtgccccaacactttctctgcttttctggagggcaagaaacccccaccccttctgcgtgtctctactcttttctctgggcttgcctccttcgctatgggcaagcttccaccttccattcctccttcttctcccttagcctgtattcttaagaacttaaaacctcttcaattctcacctgacctaaaatctaagcgcctcattttcttctgcaacaccgcttgaccccaatacaaactcgacagtagttccaaatagccggaaaacagcactttcaatttttccatcctacaagatctaaataattcttgtcgtaaaatgggcaaatggtctgaggtgcctgacgtccaggcattcttttacacatcagtcccttcctagtctctgtgcccagtgcaactcgtcccaaatctcccgcctgtcccctcagtcccaaccccaagcgtcgctgagtctttctaatcttccttttctacagacccatctgacctctcccttcctccccagcctgctccttgccaggccaagctaggtcccaattcttcctcagcctctgctcctccaccctataatctttttatcgcctcccctcacacctgatccggcttacagtttcgttccgtgactagccctcccccacctgcccagcaatttactcttaaaaaggtggctggagagctaaaggcatagtcaaggttaatgctcctttttctttatcccaaatcagatagcgtttaggctctttttcatcaaatataaaaatccagcccagttcatgacttgtttggcagcgaccctgagacgctttacagccctagaccctaaaaggtcaaaaggccgtcttattctcaatatacattttattacccaatctgctcccaacattaaataaaactccaaaaattggaatctggccctcaaaccccacaacaggacttaattaacctcaccttcaaggtgtgcaataacagaaaaaagttgcaattccttgcctccactgtgagacaatccccagtcacatctccagcacacaagaacttccaaacgcaaccaggcgttcctccggaacctcctcccccaggagcttgctacacgcgccggaaatctggccactgggccaaggaatgcccgcagcccgggattcctcctaagccgcgtcccatctgtgcgggaccccactgaaaatcggactgttcaactcacctggcagccactcccagagcccctggaactctggctcaaggttctctgactgactccttcttgacttaccggctgaagactgatgctgcctgatcgcctcagaagccccgtagaccatcacggatgccgagctttaggtaactctcacggtggagggtaagtccgtccccttcttaatcaatacggaggctacccactccacattaccttcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggctgagacactttaactaaattatctgcttccctgactattcctggactacatctatatctcattgccgcccttcttcccaatccaaagcctcctttgcgtcctcctcttgtatccccccaccttagcccacaagtataagatacctctactccctccttggcgaccgatcgtgcaccccttaccatctcattaaaacctaatcacccttaccccactcaacgccaatatcccatcccgcagcacgctttaaaaggattaaagcctgttatcactcgcctgctacagcatggccttttaaagcctataaactctccttacaattcccctattttacctgtcctaaaaccagacaagccttacaagttagttcaggatctgcaccgtatcaaccaaattgttttgcctatcccccctgtggggcccaacccgtacactcttttgtcctcaatacctccctccacaactcactattccgtgcttgatcgtaaagatgctttcttcactattcccctgcacccctcgtcccagcctctctttgctttcacttagactgaccctgacacccattaggctcagcaaattacctaggctgtactactgcaagacttcatagacagcccccattacttcagtcaagcccaaatttcatcctcatctgttacctatctcggcataattctcataaaaacacacgtgctttccctgctgatcgtgtccgattaatctcccaaacctcaatcccttacaaaataacaactcctttccttcctaggcatggttagtgcggtcagaattcttacacaagagccaggactgcgtcctgcagcctttctgtccaaacaacttgaccttactgttttagcctagccctcatgtctgcgtgcagcggctgccgctgctttaatacttttagaggccctaaaaatcacaaactatgctcaactcactctctacatttctcataacttccaaaatctattttcttcctcatacctgacgcatatactttctgctccccggctccttcagctgtactcactctttgttaagtcccacaattaccattgttcctggccgggacttcaatctggcctcccacattattcctgataccacacctgacccccatgactgtatctctctgatccacctgatactcaccccatttccccatatttccttctttcctgttcctcaccctgatcacgcttgattttttgatggcagttccaccaggcctaatcgccacacaccagcaaagccaggctatgctatagtacaagccactagcccacctctcagaacctctcatttcctttccatcgtggaaatctatcctcaaggaaataacttctcagtgtttcatctgctattctactactcctcagggattattcaggccccctcccttccctacacatcaagctccaggatttgcccccacccaggactggcaaattagctttactcaacatgcccgagtcaggaaactaaaatacctcttagtctaaatagacactttcactgaataagtaaaggcgtttcctacagggtctgagaaggccaccacagtcatttcttcccttctgtcagacataattcctcagtttagccttcccacctctatacagtctgatagcagaccagcctttattagtcaaatcagccaattagtttttcaggctcttagtattcagtgaaacctttatatcccttacggtcctctatcttcaagaaaagtagaacggactaaaggtcttttaaaaacacacctcaccaagctcagccaccaacttaaaaaggactggacaatacttttaccactttcgcttctcagaattcaggcctgtcctcagaatgctacaaggtacagcccatttaagctcctgtatagatgctcctttttattaggccccagtctcattccagacaccagaccaacttagactgtgcccccaaaaaaaacttgtcatccctactatcttctgtctagtcatactcctattctccgttctcaactactcatacatgccctgctcttgtttacactgccagtttacactgtttctccaagccatcacagctgatatctcctcgtgctatccccaaactgccacttttaactcttgaagtaaataaataatctttgctggcaggactatgctgaatctccttaggcactctctaatcagatgtcctaggtcctcccaattcttagaccttttatacctgtttttctccttcttattccatttagtttttcaattcatacaaaaccatatccaggccgtcaccaatcattctacacaacaaatgtttcttctaacatccccacaatatcaccccttaccacgagacctcccttcagcttaatctctcccactctaggttcccacgccgcccctaatcccactcgaagcagccctgagaaacatcgcccattctctctccataccaccccccaaaaattttcgtcgccccaacacttcaacactattttgttttatttttcttattaatataagaaggcaggaatgtcaggcctctgagcccaagccaagccatcgcatcccctgtgacttgcgcgtatacgcccagatggcctgaagtaactgaagaatcacaaaagaagtgaaaaggccctgccccgccttaactgatgacattccaccattgtgatttgttcctgccccaccttaactgagtgattaaccctgtaaatttccttcttctggctcagaagctcccgcactgagcaccttgtgacccccgcccctgcccaccagagaacaaccccctttgcatgtaattttccattaccttcccaaatcctataaaacggccccatccctactccctttgctgactctcttttcggactcatccggcctgcacccaggtgaaataaacagccatgttgctcacacaaagcctgtttagtggtctcttcacacagacgcgcatgaaa

SEQ ID NO: 476 - DNA, 5747 bp, Homo sapiens
gtcaggcctctgagcccaagccaagccatcgcatcccctgtgacttgcatgtatacgcccagatgtcctgaagtaactgaagaatcacaaaagaagtgaaaaggccctgccccgccttaactgatgacattccaccattgtgatttgttcctgccccaccttaactgagtgattaaccctgtgaatttccttctcctggctcagaagctcccccactgagcaccttgtgacccccacccctgcccaccagagaacaacctcctttgactgtaattttccattaacttcccaaatcctataaaacggccccaccccatctcccttcgctgactctcttttcggactcagcccgcctgcacccaggtgaaataaacagccatgttgctcacacaaagcctgtttggtggtctcttcacagggacacggatgaaatttggtgccgtgactcggatcggggaacctcccttaggagatcaatcccctgtactccttttctttgccctgtgagaaagatccacctatgacctcaggtcctcagaccgaccagcccaaggaacatctcaccaattttaaatcaggtaagcggcctcttcttactctcttctccaacctctctcactgtccctcaaccactttctcctttccactcttcaatctctcccttctcttaatttcaattcctttcattttctgggagagacaaaggagacacgttttatccatggacccaaaactccggcgccggtcacggactgggaaggcagccttcccttggtgtttaatcattgcagggatgactctctgattatatacccacatttcaagggtgtcagaccacgcagggacacctgccttggtccttcactcttagcggcaagtcccgcttttctggggaaggggcaagtacctcaaccccttctctccttgtctctaccccttctctggtttcctggggcaggggcaagtaccccaaccccttctccttcacccttagccacaagttccgctttcctggggcaggggcaagtacccctcaaccccttctccttcacccttagcagccaagtcccgctttcctagggggcaagaacccccccaatcgcttatttccgcaccccaacctcttatctctgtgccccaatcccttatttccgcaccatgacctcttatctctgtgccccaatcccttatttccgtgccccaaccccttctctgcttttctggagggcaaggaccccctaccccttctccgtgtctctactcttgtctgggcttgcctccttcactatgggcaagcttccaccttccattcctcctccttctcccttagcctatattcttaagaacttaaaacctcttcaactcacacctgacctaaaacctaaatgccttattttcttctgcaatgccgcttgaccccaatacaaactcaacagtagttccaaatagccagaaaatggcactttgaatttttccatcctgcaagatctaaataattcttgtcataaaataggcaaacggtctgaggtgcctgacgtccaggcattcttttacacatcagtcccttcctagtctctgtgcccagtgcaactcgtcccaaatcttccttctctccctcccgcctgtcccctcagtaccaaccccaagcgtcactgagtctttctaatcttccttttctacagacccatctgacctctcccttcctccccaggctgctcctcgccaggccgagctaggtcccaattctttctcagcctctgctcctccaccctataatctttttatcacctcccctcctcacacctggtccggcttacagtttcgttccgtgactagccctcccccacctgcccagcaatttactcttaaaaagccaaaggcatagtcaaggttaatgctcctttttctttatcccaaatcagatagcgtttaggctttttcatcaaatataaaaatccagccccgttcaaggctcgtttggcagccaccctgagacgctttacagccctagaccctaaaaggtcaaaaggccgtcttattctcaatatacattttattacccaatctgctcccgacattaaataaaactccaaaaattggaatctggccctcaaaccccacaacaggacttaattaacttcaccttcaaggtgtacaataacagaaaaaagttgcaattccttgcctccactgtgagacaaaccccagccacatctccagcacacaagaacttccaaacgcctgaaccgcagcggccaggtgttcctccagaacctcctcccacaggagcttgctacacgtgccggaaatctggccactgggccaaggaatgcccgcagcccgggattcctcctaagccgcgtcccatctgtgtgggaccccactgaaaatcggactgttcaactctcctggcagccactgccagagcccctggaactctggcccaaggctctctgactgactccttcccagatcttctcggcttagcggctgaagactgacactgcccgatcgcctcggaagccccctagaccatcacggacgccgagcttcggtaactctcacagtggaaggtaagcccgtccccttcttaatcaatacggaggctacccactccacattaccttcttttcaagggcctgtttcccttgcctccataactgttgtgggtattgacggccaggcttctaaacctcttaaaactccccaactgtggtgccaacttagacaacactcttttaagcactcctttttagttatccccacctgcccagttcctttattaggctgaaacactttaactaaattatctgcttccctgactattcctgaactacagctatatctcattgccgcccttcttcccaatccaaagcctcctttgcgtcctcctcttgtatccccccaccttaacccacaagtataagatacctctactccctccttggcgacggatcatgcaccccttaccatctcattaaaacctaatcacccttaccccactcaatgccaatatcccatcctgcagcacgctttaaaaagattaaagcctgttatcactcgcctgctacagcatggcctttcaaagcctataaactctccttacaatttctccattttacctgtcctaaaaccagacaagccttacaagttagttcaggatctgcgccttatcaaccaaattgttttgcctatccaccccatagtgccaaacccatatactctcctatcctcaatacctgcctctataacccattattctgttctagatctcaaacatgctttctttactatttctttgcacccttcatcccagcctctcttcactttcacttggactgaccctgacacccatcaagctcagcaaattacctaggctgtactgctgcaaagcttcacagacagcccccattacttcaatcaagcccaaatttcttcctcatctgttacctaattcagcataattctcataaaagcacacgtgctctccctgccaatcgtgtctgactgatctctcaaaccccagcaccttctacaaaacaacaactcctttccttcctaggcatggttagcatggtcagaattcttatacaagagccaggaccacaccctgtagcctttctgtccaaacaacttgaccttactgttttagcctagccctcatgtctgtgtgcagtggctgccgctgctttaacactgttagaggccctaaaaatcacaaactatgctcaactcactctctacatttctcataacttccaaaatctattttcttcctcatacctgacgcatatactttctgctctccggctccttcagctgtactcactctttaagtcccacaattaccattgttcctggcccggacttcaatctggcctcccacattattcctgataccacacctgaccctcatgactgtatctctctgatcctcctgatattcaccccatttccccatatttccttctttcctgttcctcaccctgatcacacttgatttattgatggcagttccaccaggcctaatcgccacacaccagcaaaggcaggctatgctatagtacaagccactagcccgcctctcagaacctctcatttcctttccatcgtggaaatctatcctcaaggaaataacttctcagtgttccatctgctattctactactcctcagggattattcaggccccctcccttccctacacatcaagctcgaggatttgcccccacccaggactggcaaattagctttactcaacatgtcccgagtcaggaaactaaaatacctcttagtctaaatagacactttcactgaataagtaaaggcctttcctacagggtctgagaaggccaccacagtcatttcttcccttctgtcagacataattcctcagtttagccttcccacctctatacagtctgataacagaccagcctttattagtcaaatcagccaagcagtttttcaggctcttagcattcagtgaaacttttatatcccttagggtcctccgtcttcaagaaaagtagaatggactaaaggtcttttaaaaacacacctcaccaagctcagccaccaacttaaaaaggactggacaatatttttaccactttcccttctcagaattcaggcctgtcctcggaatgctatagggtacagcccatttgagctcctgtatagacgctcctttttattaggccccagtctcattccagacaccagaccaacttagactgtgccccccaaaaaaacttgtcatccctactatcttctgtctagtcatactcctattcaccgttctcaactactcatacatgccctgctcttgtttacactgcctgtttacactgtttctccaagccatcacagctgatatctcctggtgctatccccaaactgccacacttaactcttgaagtaaataaataatcttggctggcaggactatgctgaatctccttaggcactctctaatcagatgtcttaggtctaaggaccttttatacctgtttttctccttctcttattccatttagtttttcaattcatacaaaaccgtatccaggccatcaccaatcattctatatgacaaatgtttcttctaacaaccccacaataccaccccttaccacaagacctcccttcagcttaatctctcccactctaggttcccacactgcccctaatcctgcttgaagcagccctgagaaacatcacccattctctctccataccacccccaaaaattttcgccaccctaatacttcaacactattttgttttatttttcttattaatataagaaggcaggaatgtcaggcctctgagcccaagccaagccatcgcatcccctgtgacttgcatgtttatgcccagatggcctgaagtaactgaagaatcacaaaagaagtgaaaaggccctgccccgccttaactgatgacattccactattgtgatttgttcctgccccaccttaactgagtgattaaccctgtgaatttccttctcctggctcagaagctcccccactgagcaccttgtgacccccgcccctgcccaccagagaacaaccccctttgactgtaattttccattaacttcccaaatcctataaaacggccccacccctatctcccttcgctgactcttttcggactcatccggcctgcccccaggtgaaataaacagccatgttgctcacacaaagcctgtttggtggcctcttcacatggacgcacatgaaa

SEQ ID NO: 477 - DNA, 5347 bp, Homo sapiens
tgactctctttttggactcagcccacctgcatccaggtgaaataaacagctttattgctcacacaaagcctgtttggtggtctcttcacatggacgcgcatgaaatttggtgccgtgacttggatcgggggacctcccttgggagatcaatcccctgtcctcctgttctttgctccgtgagaaagatccacctacgacctcaggtcctcagaccgaccagcccaaggaacatctcaccaattttaaatcaggtaagcggcctcttcttactctctttctccaacctctctcactgtccctcaaccactttctcctttccactcttcattctctcccttctcttaatttcaattcctttcattttctgggagagacaaaggagacacattttaccagtgggcccaaaactccggcgccagtcacagactgggaaggcagccttcccttggtgtttaatcattgcagggaagcctctctgattattgacccacgtttcaaaggtgtcagaccacgaagggatgcctgccttggtccttcacccttagcggcaagtcccgcttttctggggaaggggcaagtaccccaaccccttctctccttgtctctaccccttttctgcttttctgggggaggggcaagtacccctcaaccccttctccttcacccttagcggcaagtcccgcttttctagggggcaagatcccccaatcccttatttccatgccccaacctcgtatctctgcgccccaatcccttatttctgtgccccaacctcttatctctgtgccccaatcccttatttccatgccccgaccccccttcctgcttttcgggagggtaagaacccccaaaccccttccctccgtgtctctacgctctcttttctctgggtttgcctccttcactatgggcaaccttccaccctccattcctccttcttctcccttagcctgtgttctcaaaaacttaaaacctcttcaactcacacctgacctaaaacctaaatgccttattttcttctgcaatgccgcttgaccccaatacaaactcgacagtatttgtccaaatagccagaaaatggcactttgaatttttccatcctgcaagatctaaataattcttgtcataaaatagggaaatggtctgaggtgcctgacgtccaggcattcttttacacatcagtcccttcctagtctctgtgcccagtgcaacttgtcccaaatcttccttctttccctcccacctgtcccctcagtaccaaccccaagcgtcgctgagtctttctaatcttccttttctacagacccatctgacctctcccttcctccccaggctgctcctctccaggccgagctaggtcccaattcttcctcagcctctgctcctccaccctataatctttttatcacctcccctcctcacacctggtccggcttacagtttcgttccgtgactagccctcccccacctgcccagcaatttactcgtaaaaaggtggctggagccaaaggcatagtcaaggttaatgctcctttttctttatcccaaatcagaagcgtttaggctctttttcatcgaatataaaaatccagcccagttcatggctcgtttggcagcaaccctgagacgctttacagccctagaccctaaaaggtcaaaaggccgtcttattctcaaaatacattttattacccaatctgctcccgacatcaaataaaactccaaaaattaaattctggccctcaaaccccacaacaggacttaattaacctcaccttcaaggtgtacaataacagaaaaaagttgcaattccttgcctccactgtgagacaaaccccagccacatctccagcacacaagaacttccaaatgcctgaactgcagcggccaggcgttcctccagaacctcctcccccaggagcttgctacaagtgctggaaatctggccactgggccaaggaatgcccacagcccgggattcctcctaagccgcgtcccatctgtgtgggaccccactgaaaatcggactgttcaactcacctggcagccactcccagagcccctggaactctggcccaaggctctctgactgactccttcccagatcttctcggcttagcggctgaagactgacactgcccaatcgcctcggaagccccctagaccatcagggacgccgagcttcgggtaactctcacagtggaaggtaagcccgtccccttcttaatcaatactgaggctacccactccgcattaccttcttttcaagggcctgtttcccttgcctccataactgttgtgggtattgacagccaggcttctaaacctcttaaaactccccaactctggtgccaacttagacaatactcttttaagcactcctttttagttatccccacctgcccagttcccttattaggctgagacactttaactaaattgtctgcttccctgactattcctagactacagctatatctcgttgccgcccttcttcccaatccaaagcctccttttcgtcctcctcttgtatccccccaccttaacccacaagtataagatacctctactccctccttggcaaccgatcatgcaccccttaccatctcattaaaacctaatcaccgttaccccaactcaacgccaagatcccatcccgcaacacgctttaaaaagattaaagcctgttatcactcgcttgctgcagcatggccttttaaagcctataaactctccttacaattcccccattttacctgtcctaaaaccagacaagccttacaagttagttcaggatctgcaccttatcaaccaaattgttttgcctatccaccccgtggttccgaacccatatactctcctatcctcaatacttgcctctacaacccattattctgttctggatctcaaacatgctttctttactattcctttgcacccttaatcccagcctctcttcgctttcacttggactgaccctcacacccatcaagctcagcaaattacctgggctgtactgccacaaagcttcacggacagcccccattacttcaatcaagcccaaatttcttcctcatctgttacctatctcggcataattctcataaaaacacacgtgctctccctgccaatcgtgtccgactgatctctcaaaccccagcaccttctacaaaacaacaactcctttccttcctaggcatggttagtgcggtcagaattcttacacaagagccaggaccgcaccctgtagcctttctgtccaaacaactcgaccttactgttttagcctagccttcatgtctgcgtgcggcggctgccgctgctttaatatgttagaggccctaaaaatcacaaactatgctcaactcactctctacatttctcataacttccaaaatctattttcttcctcatacttgacacatatactttctgctccccggctccttcagctgtactcactctttaagtcccacaattaccattgttcctggcccggacttcaatctggcctctcacattattcctgataccacacctgacccccatgactgtatctctctgatccacctgatattcaccctatttccccatatttccttctttcctgttcctcaccctgatcatgcttgatttattgatggcagttccaccaggcctaatcgccacacaccagcaaaggtaggctatgctatagtacaagccactagccggcctctgagaacctctcatttcctttccatcgtggaaatctatcctcaaggaaataacttctcagtgttccatctgttattctactactcctcagggattattcaggccccctcccttccctacacatcaagctggaggatttgcccccacccaggactggcaaattagctttactcaacatgcccgagtcaggaaactaaaatacctcttagtctaaatagactctttcactgaataaatagaggcctttcctacagggtctgagaaggccatcgcagtcatttcttcccttctgtcagacataattcctcagtttagccttcccacctctatacagtctgataacagaccagcctttattagtcaaatcagccaagcagtttttcaggctcttagtattcagtgaaacctttatatcctttatggtcctccatcttcaggaaaagtagaatggactaaaggtcttttaaaaacacacctcaccaagctcagccaccaacttaaaaaggactgaacaatacttttaccactttctcttctcagaattcaggcctgtcctcagaatgttacaaagtacagcccatttaagctcctgtatagacactcatttttattaggccccagtctcattcgacaccagaccaacttagactgtgccccaaaaaaacttgtcatccctactatcttttgtctagtcatactcctattcactattctcaaatactcatacatgccccgctcttgtttacactgccggtttactgtttctccaagccatcacagctgatacctcctggtgctatccccaaactgccactctaaactcttgaagtaaataaataatctttgctggcaggactatgctgaatctccttaggcactctctaatcagatgtcctaggtcctcccaattcttagaccttttatacctgtttttctccttctcttattccatttagtttttcaattcatgcaaaaccatatccaggccatcaccaatcattctatatgacaaatgttccttctaacaaccccacaatatcaccccttaccacaagatcttcctccagcttaatctctcccactctaggttcccacgccgcccctaatcctgctcgaagcagccctgagaaacatcgcccattctctctccataccacccccaaaaattttcgccgccccagcacttcaacactattttcttttatttttcttattaatataagaaggcaggaatgtcaggcctctgagcccaagccaagccattgcatcccctgtgacttggacgtatacgcccagatggcctgaagtaactgaagaatcacaaaagaagtgaaaaggccctgccccatccttaactgatgacattccaccattgtgatttgttcctgccccaccttaactgagtgattaaccctgtgaatttccttctcctggctcagaagctcccccactgagcaccttgtgacacctgcccctgcccaacagagaacaaccccctttgactgtaattttcattaacttcccaaatcctataaaacggccccacccctatctcccttcactgactctctttttggactcagcccacctgcacccaggtgaaataaacagctttattgctcacacacac

SEQ ID NO: 478 - DNA, 4792 bp, Homo sapiens
gaattcagcccagccagagtgcatgtacctttttctctctcagacttaaagcacattaaaatagacctaggtaaattctcagataaccctgatggctatattgatgttttacaagggttaggacaatcctttgatctgacatggagagatataatgttactgctagatcagacacttaccccaaatgagagaagtgccaccataactgcagcccgagagtttggtgatctctggtatctcagtcaggtcaatgacaggatgacaacagaggaaagagagtgattccccacaggccagcaggcagttcccagtgtagaccctcattgggacacagaatcagaacatggaaattggtgtcacagacatttgctaacttgcgtgctagaaggactaaggaaaactagaaagaagcctatgaattattcaatgatgtccactataacacagggaaaggaagaaaatcctactgcctttctggagagactaagggaggcattgaggaagcatacctccctgtcacctgactcttttgaaggccaactaatcttaaaggataagtttatcactcagtcagctgcagacaaaagaaaaaaacttcaaaagtcccccttaggcccagagcaaacttaaaaaccctattgaacttaggaacctcagttttttataatagagatcaggaggaacaggtgcaaaaggaaaaacgggattaacaaaaaggccaccttagtcatggccctcaggtgagtggactttgaaggctctggaaatgggaaaagccgggcaaatagaatgcctaatagggctcgctttcagtgcgatctacaaggacactttaaaaaagattgtccaagtataaataagttgcccccttgtccatgccccttatgtcaggggaatcactggaaggcccactgccccaggagacgaaggtcctcttagtcagaagccactaaccagattgatccagcagagcaggactgagggtgcctggggcaagcaccagcccatgccaatcaccctcacagagccccaggtatgcttgaccatggagggctaggaggttaactatctcctggacactggtgcggccttctcagtcttactctcctgtcccggacaactgtcctccagatctgtcactatccgaggggtcctaggacagccagtcactggatacttctcccagccactaagttgtgactggggaactttattcttttcacatgcttttctaattatgcctgaaagccccactcccttgttagggagagacattctagcaaaagcaggggccattatacacctgaacataggagaaggaacactgtttgttgtcccctgcttgaggaaggaattaatcctgaagtctgggcaacagaaggacaatatggacaagcaaagaatgcccgtcctgttcaaattaaactaaagaattccacctcctttccctaccaaaggcagtacccccttagacccaaggcccaacaaggactccaaaagattgttaaggacctaaaagcccaaggcctagtaaaaccatgcagtagcccctgtgagtctctaattttaggagtacagaaacccaacggacagtggaggttagtgcaagatctcaggattatcaatgaggccgtttttcctctatacccagctgtacctaacctttatactctgctttcccaaataccaaaggaagcagagtggtttccagtcctggaccttaaggatgcctttttctgcatccctgtacatcctgactctcaattcttgtttgcctttgaagatccttcaaacccaacgtctcaactcagctggactgttttgccccaagggttcagagatagcccccatctatttggccaggcattagccaagacttgagccagttctcatacctggatgctcttgtcctttggtacgtggatgatttacttttagctgcctgttcagaaaccttgtgccatcaagccacccaaacactcttaaatttccttgcctcctgtggctaaggggtttccaaaccaaaggcacagctctgctcacagcaggttaaatacttagggctaaaattatccaaaggcaccagggccctctgtgaggaatgtatccagcctatactggcttattctcatcccaaaaccctaaagcaactaagagcattccttggcataacaggcttctgctgaatatggattcccaggtacagtgaaatagccaggccattatatacacaaattaaggaaactcaaaaagccagcacccatttagtaagacggactcctgaagtagaagcggctttccaggccctaaagaaggccctaatccaagccccagtgttaagcttgccaacagggcaagacttttctttatatgtcacagaaaaaaacaggaatagctctaggagtccttacacaggtctgagggaccagcttgcaacccatggcatacctgagtaaggaaattgatgtagtggcagaggattggcctcactgtttacaggtagtggcagcagtagcagtcttagtatctgaagcagttaaaataatacaaggaagaaatcttactgtgtggatatctcatgatgtgaatggcatactcactgctaaaggagacttgtggctgtcagacaaccgtttacctaaacatcaggctctattacttgaagggccagtgctgggactgcgtacttgtgcaactcttaacccagccacatttcttccagacaatgaagaaaagatagaacataactgtcaacaggtaattgctcaagcctatgccactcgaggggaccttctagaggttcccttgactgatcctgacctcaacttgtatactgatggaagttcctttgtagaaaaaggactttgaaaagcggggtatgcagtggtcagtgataatggaatacttgaaagtaatcccctcactccaggaactagtgctcagctggcagaactaatagccctcactcaggcactaaaattaggagaagaaaaagagagaagactctaagtatgcttacctagtcctccatgcccacacagcaatatggagagaaagggaattcctaacttctgagggaacacctatcaaacaacaggaagccattaggagattattattggctgtacagaaacctaaagaggtggcagtcttacactgctggggtcatcagaaaggaaaggaaagggaaataaaagagaatcaccaagcggatattaaagcaaaaacagcctcaaggcaggacgctccattagaaatgcttatagaaggacccctagcatggggtaatcccctccgggaaaccaagccccagtactcagcagaagaaataggatggggaaactcacgaggacatagtttcctcccctcaggaaggctagccaccaaagaaggaaaaatactcctgcctgcagctaaccagtgaaaattacttaaaacccttcaccaaacttttcacttaggcattgatagcacccatcagatggccaaatcattatttacaggaccaggccttttcaaaactatcaagcagatagtcaggacctatgaagtgtgccaaagaaagaaccccctgcactgcaggtcatacatttcaattcctgtatctgtaacctccttgttaagtttgtctgttccagaactgaagatgtaaaactacaaatggttcttcaaatggagccccagatgtagtccatgactaagatctaccatggacccctggactggcctgctagcccatgctccaatgttgatgacatcgaaggcacccctcccgaggaaatctcaactgcatgacccctactatgccccaattcaacaggaagcagttagagcagttgtcagccaacctccccaacagcacttgggttttcctgttgagagggggcactgagagacaggactagctggatttcctaggccaactaagaatccctaagcccagctgggaaggtgactgcatccacctttaaacacggggcttgcaacttagctcacacccgaccaatcaggtagtaaagagagctcactaaaatgctaattaggcaaaaacaggaggtaaagaaatagccaatcatctatcacctgagagcacagtgggagggacaatgattgggatataaacccaggcatttgagccggccatggtaaccccctttgggtcccctcccattttatgggagctctgttttcactctattaaatcttgcaactgcacactcttctggtccgtgtttgttacggctcgagctgagctttcgctcaccgtccaccagtgctgtttgtcgctgttgcagacccaccactgacttccacccctccggatccaacagggtgtctgctgtgctcctgatccagtgaggcacccattgctgtgctggactgggctaaaggcttgccattgttcctgcatggctaagtgcccaggttcatcctaatcgagctgaacactagtcactgggttccacggttctcttctgtgacccatggcttcttttttttttttttttttttgagatggagtcttgctctgttgcccaggctggagtgcagtggtgccatctcagcttactgcaagctctgcctcccgggttcacgccatactcctggccaccatgcctggcctgacccacagcttctaatagagctataacactcaccacatggcccaagattccgttccttggaatccatgaggccacgaaccccaggtcagagaacaagaggcttgccgccatcttggaagtggcccacaaccatcttgggagctctgggagcaaggaccccctggtaa

SEQ ID NO: 479 - DNA, 5745 bp, Homo sapiens
gtcaggcctctgagcccagctaagccatcatatcccctgtgacctgcacatacacacctagatggccagttcctgccttaaccaatgacagtccaccacaaaagaagtgaaaatggcctgttcctgccttaactgatgacattatcttgtgaaattccttctcctggctcatcctggctcaaaacgtcccctgctgagcaccttgtgaccccccactcctgcctgccagagaacaaccccacttcttcctttacctacccaaatcttataaaatggccccaccctatctccctttgctgactgtctttcggactcagcccggttgcacccaggtgaaataaacagccttgttgctcacacaaagccggtttggcggtctcttcacacagacgtccatgaaatttggtgccgtgactcggatcgggggacctcccttgggagatcaatcccctgctctcctgctctttgctccgtgagaaagatccacctatgacctcaggtcctcagaccgaccagcccaaggaacatctcactaatttcaaatctggtaagtggcctctttttactctcttctccaacctccttcactatccctcaacctctttctccttcaatcttggcaccacacttcaatctctcctttctcttaacttcagttcctttccttttctggtagagacaaaggagatgcgttttatccatggacccaaaactccggcgccggtcacggactcaggaaggcaggcttcccttgctgtttaatcattgcgggacgcctctctgattattcacccacgttccattggtgtctgatctccgtggggatgcctgccttgatcattcacccatgttcccttggtggcaagtcaattgcggggacgcctgctttggctgctcacccacattgcagcccagagctgctccccacccccttctccgtgtctctacccttctctttaaacttgcctccttcactataggcaaccttccaccctccattcctcctcctcccttagcctgtattctcaagaacttaaaacctcttcaactcacacctgacctaaaacctaaacaccttattttcttctacaatgacacttgaccccaatacaaactcgacagtagttccaaatagccagaaaatggcacttgctatttttccatcccacaagatctaaataattcttgtcgtaaaataggcaaatggtctgaggtgcctgacgtccaggcattcttttacacattggtccctccctagtctctgttcccaatgcaactcgtcccaaatcttccttctttccctcctgcctgtcccctcagtcccaaccccaagtgtcactgagtctttctaatcttccttttctacagatccatctgacctctccccagctcggcaggccaagctaggtcccaattcttcctcagcctctgctcctccaccctataatccttttatcacctcccctcctcacactcggtctggcttacagtttcattctgtgactagccctcccccacctgcccggcaatttcctcttaaaaaggtggctggagctaaagccataatcaaggttaatgctcctttttctttatcgcaaatcagatagcatttaggctctttttcatcaaatataaaaatccagcccagttcatggcttgtttggcagcaaccctgagatgctttacagccctagaccctaaaaggtcaaaaggccatcttattctcaatatacattttattacccaatccactcccaacattaaataaaactccaaagactaaattccagccctcaaacccctcaacaggacttaattaaccttgcctttgaggtgtacaataatagagtagaggcagccaaatagcaacatattcctgagttgcaattccttgcctccactgtgagacaaaccccagccacatctccagcacacaagaacttccaaacgcctaaaccgcagtggccaggcattcctccagaactgcctcccccaggagcttgctacaagtgccagaaatctggccaccaggccaagggatgcccgcagcccaggattcctcctaagccacatcccatctgtgcaggaccccactggaaatcagactgtccaactcacctggcagccactcccagagcccctggaactctggcccaaggctttctgactgactccttcccagatcttctcggcttagcagctgaagactgacactgcccaatggcctcagaagccccctagaccatcatggatgccgagcttcgaatagctctcacagtggaaactaagtccgtccccttcttaatcaatacggaggctacccactccacattaccttcttttcaagagtctgtttcccttgcctccataactgttgtaggtattgatggccaggcttctaaacctcttaaaactccccaactctggtgccaacttagacaatacctttttaagcactcctttttagttatccccacctgcccagttcccttattaagctgagacattttaactaaattatctgcttccctgactattcctggactacagccacatctcattgccacctttcttcccaatccaaagcctcctttgtgtcctcctcttgtacctgccccccccaccttaacccacaagtataggatacctctactccctccttggtgaccgatcatgcactccttaccatctcattaaaacctaatcacccttaccccgctcaatgccaatatcccatccgcagtgcactttaaaaagattaaagcctgttatcactcgcctgctacagcatggccttttaaagcctataaactctccttacaatttccccattttacctgtcctaaaaccagacaagccttacaagttagtttaggatctgcgccttatcaaccaaattgttttgcctatccatcctgcggtgccaaacccatagactctcctatcctcaatacctccctccacaacccattattctgttctggatctcaaacatgctttctttactattcctttgcactcttcgtcccagcctctctctgctttcacttggactgacccttggactgaccctgacatgcatcacgctcagcaaattacgtgggctgtactgccgcaaagcttcacaaacagtccccattacttcagtcaagcccaaatttcgtcctcatctgttacctatctcggcataatgctcataaaaacacacgtgctctccctgccaatcatgtctgactgatctctcaaaccccaacaccttctacaaaacaactcctttccttcctaggcatggttacatactttcaactttagatacctggttttgccatcctaacaaaaccattatataaactcacaaaaggaaacctagctgaccccatagatcctaaatccttttcccactcctctttccattccttgaagacagctttagagactgcccccaccctagctctccctgactgatcccaacccttttcattacccacagccgaagtgcagggctgtgcagtcagaattcttacacaagaaccgggaccgtgccctgtagcctttttatgcaaacaacttgaccttactgttttgcctagccctcaagtctgcgtgcagtggccgccacgaccctaatactttcagaggcccttaaaatcacaaactatgttcaactcgctctctacagttctcataacttccaaaatctattttcttcctgacacctgacacatatactttctgctccccagctccttcagctgtactcactctttgttgagtctcccacaattatcattgttcctggcccagacttccatccggcctcccacattattcctgataccacacctgacccctatgactgtatctctctgatccacctgacattcaccccatttccccgtatttccttctttcatgttcctcaccctgatcacacttggtttattgatggcagttccaccaggcctaatcgccacacaccagccaaggcaggctatgctatagtagaagccactagcctacctcttagaacctctcatttcctttccatcatggaaatctatcctcaaagaaataacttctcagtgttccatctgctattctactatttctcagggatgattcaggccccctcccttccctacacatcaagctcagggatttgcccccacccaggactagcaaatttgctattctactacttctcagggattattcaggccccctccgtccctacacatcaaactcaaggatttgcccctgcccagaactggcaaattgactttactcaacacgccccgagtcaggaaactaaaatacctcttggtctaggtagacactttcactggataggtagaggcctttcccacagggtctgagaaggccaccatggtcatttcttcccttctgtcagacataattcctcggtttggccttcccacctctatacagtccgatagcagaccggcctttattagtcaaatcagccaagcaggttttcaggctcttggtattcagtgaaacctttatatcccttatggtcctcagtcttcaggaaaggtagaatggactaaaggtcttttaaaaacacacctcaccaagctcagccaccaacttaaaaaggactggacgatacttttaccactttcccttctcagaattcatgcctgtcctcagaatgctacagggtacagcgcatttgagctcctgtatagacgctcctttttattaggccccagtctcattccagacagcagaccaacttggactgtgctccaaaaaacttgtcatccctactatcttctctctagtcatactcctattcaccattctcaactactcatacatgccctgctcttgtttacactgccggcttacactgtttctccaagccatcacagctgatatctcctggtgctatcgccaaaccaccactcttaactcttaaagtaaataaataatctttgctggcaaggctattctgaatctccttaggcattctttaattagatgtcctaggtcctcccaattcttagtcctttaatacctgtttttctccttctcttattccgttcagtttttcaattcatacaaaacagcatccaggccatcaccaataattctacatgacaaatgtctcctctaacaaccccacaatatcaccccttaccacaaaatcttccttcagcttaatctctcccactctaagttcccaagccgcccctaatcctgctcgaagcagccccgagaaacaccgcccgttatctctccataccaccccccaaaattttcgccatcccaacactttaccactatttcattttatttttcttattaatataagaaaacaggaatgtcaggcctctgagcccaagctaagccatcatatcccctgtgacctgcacatacacatccagatggctggttcctgcctttactgatgacattccaccacaaaagaagtgaaaatggcctgttcctgccttaactgatgacattatcttgtgaaattccttctcctggctcaagacctcccctactgagcaccccgtgacaccccccactcctgcctgccagagaacaaccccctttttcctttaaacgcaaatcttatcaaacgggcccacccctatctcccttcgctgactctcttttcggactcggcctgcctgcacccaggtgaaataaacagccttgttgctcacacaaagcctgtttgatggtttcttcacacagacgtgcatgaaa

SEQ ID NO: 480 - DNA, 3569 bp, Homo sapiens
gtcaggcctctgagcccaagctaagccatcatatcccctgtgacctgcacgtacacatccagatggccggttcctgccttaactgatgacattccaccacaaaagaagtgaaaatggcctgttcctgccttaactgatgacactgtcttgtgaaattccttctcctggctcatcctggctcaaaagctcccccactgagtaccttgtgacccccactcctgaccgacagagaacaaccccctttgactgtaattttcctttatctacccaaatcctataaaacggccccacccttatctcccttcgctgactctcttttcggactcagcccacctgcacccaggtgattaaaagctttattgctcacacaaagcctatttggtggtctcttcacacggacgcacatgaaatttggtgccgtgactcggatggtggtgggggggcctcccttgggagatcaatcccctgtcctcctgctctttgctccatgagaaagatccacctacgacctcaagtcctcagaccaaccagcccaagaaacatctcaccaatttcaaatccggtaagcggcctctttttactctcttctccaacctccctcactatccctcaacctctttctcctttcaatcttggcgccacacttcaatctctcccttcttttaatttcaattcctttcattttctggtggagacaaaggagacacgttttatccgtggacccaaaactccagcgccggtcacagactgggaaggcagccttcccttggtgtttaatcattgcagggacgcctctctgataactcacccatgtttcagaggcgtcagaccacgcagggacgcctgccttgctccttcacccttagcggcaagtcccgcttttctgtaggaggggcaagtaccccaaccccttctctccttgtctctaccccttctccgcctttctggggggtaagaaacccccaaccccttctccttcacccttagcggcaagtcccgcttttctaggggtggggcaagtaccccaaccccttatatctctgcaccccgatcccttatttccacgccccaacctcttatacctctgcgccccgatcccttatttccacgccccaacctcttatatctctgcatcccaatcccttatttccgtgccctgacctcgtatctctgtgccccgacccctttcccgcttttctggagggtaagaacccccaaaccccttccctccatgtctttatgctctcttttctctgggcttgcttccttcactatgggcaaccttccaccctctattcctccttcttctcccttagcctgtgttcttaagaacttaaaacctctccaactctcacctgacctaaaatctaagcatcttattttcttctgcaatgccgcttgaccccaatacaaactcgacagtagttccaaatagccagaaaacggcactttcaatttttccatcctgcaagatctaaataattcctgtcgtaaaatgggcaaacggtctgaggtgtctgacgtccaggcattcttttacacatcggtccctccctagtctctgtccccagtgcaactcgtcccaaatcttccttctttccctcccacctgtcccctcagtcccaaccccaagcattgctgagtctttctaatcttccttttctacagacccatctgacctctcccctcctccccaggctgctcctcgccaggccgagctaggtcccagttcttcctcagcctccactcctccatcctataatccttttatcacctcccctcccctcctcacacctggtctggtttacaatttcattccgtgagtagccctcctccacctgcccagcaatttcctcttaaaaaggtggctgaagctaaaggcatagtcaaggttaatgctcctttttctttatcagacctctcccaaatccgtgagcctttaggctctttcatcaaatatgaaaaacccagcccagttcatggctcgttcggcagcaaccctgagacgctttacagccctagactctaaaaggtcaaaaggccgtcctattctcaaaatacattttattacccaatctgctcccgacattaaataaaactccaaaaattaaattccggccctcaaaccccacaacaggatttaattaacctcgccttcaaggtgtacaataatagaaaaaagttgcaattccttgcctccacggtgagacaaaccccagccacatctccagcacacaacttccaaacgcctgaaccgcagcggccaggcgttcctccagaacctcctcccccaggagcttgctacaagtgtcagaaatctggccaccaggccaaggaatgcctgcagcccaggattcctcctaagctgcgtcccatctgtgtgggaccccactggaaatcggactgtccaactcacctggcagccactcccagagcccctggaactctggcccaaggctgtctgactgcttcccagatcttcttggcttagcggctgaagaccgacgctgcctgattgcctcggaagccccctagaccatcacggacgccgagcttcgggtaactctcacagtggaaggtaagtccgtccccttagtcaatacggaggctccccactccacattaccttcttttcaagggcctgtttcccttgcctccataactgttgtgggtattgacggccaggcttctaaacccctgaaaactcccccactctggtgccaacttggacaacactcttttctgcacttttttagttatccccacctgcccagttcccttattaggccgagatactttaaccaaattatctgcttccctgactattcctggactacagctgcatctcattgccgcccttctccccaacccaaagcctccttcgcgtcttcctctcgtatccccccaccttaacccacaagtatgggacatctctactccttccctggcaaccgatcacatgcccattaccatcccattaaaacctaatcacccttaccccgctcaatgccaatatcccatcccacagcacgctttaaaaggattaaagcctgttatcactcgcctgctacagcatgggcttctaaaacctataaactctccttacaattcccccattttacctgtcctaaaaccggacaagtcttacagattagttcaggatctgcgccttatcaaccaaattgttttgcctatccaccctgtggtgccaaacccgtacactctttcgtcctcaataccttcctccacaactcactattccgttctcgatcttaaagatgctttttcactattcccctgcacccttcgtcccagcttctctttgctttcacttagactgaccctgacacccattaggctcagcaaattacctgggctgtactgccgcaaggcttcacagacagcccccattacttcagtcaagcccaaatttcatcctcatctgttacctatctcggcataattcttataaaaccacacgtgttttccctgctgatcgtgtccgattaatctcccaaacctcaatcccttacaaaacaacaactcctttccttcctaggcatagttag

SEQ ID NO: 481 - DNA, 5663 bp, Homo sapiens
gtcaggcctctgagcccaagccaagccatcgcatcccgtgacttgcacatatacacccagatggcctgaagtaactgaagatccacaaaagaagtaaaaatagccttaaggatgacattccaccattgtgatttgttcctgccccaccctaactgatcaatgtactttgtaatctcccccacccttaagaagtttctttgtaattctccccacccttgagaatgtactttgtgagatccacccctgcccgcaaaacattgctcttaacttcaccgcctgacccaaaacctgtaagaactaatgataatccatctcccttcgctgactctcttttcggactcagcccgcctgcatccaggtgaaataaacagccgtgttgctcacacaaagcctgtttggtggtctcttcacacggacgcacatgaaatttggtgccgtgactcggatcgggggacctcccttgggagatcaatccccctgtcctcctgctctttgctccatgagaaagatccacctacgacctcaggtcctcagaccgaccagcccaaaaaacatctcaccaatttcaaatccagtaagcggcctctttttactgtcttctccagcttccctcactatccctcaacctctttctcctttcaatcttggcgccgcacttcaatctctcccttctcttaatttcagttcctttcattttctggtagagacaagggagacacgttttatccgtggacccaaaactccggcgccggtcacgggctgggaaggcagccttcccttggtgtttaatcattgcagggacgcctctgattattcacccacgtttcaaaggtgtcagaccacgcagggacgcctgccttggtccttcacccttagcggcaagtcccgcttttctgaggaaggggcgagtaccccaaccccttctctccttgtctctaccccttctgtgatttttctggggcaggggcaagaacccctcaaccccttctccttcacccttagcggcaagtcccgcttttctaggtggcaagaacccccaatcccttatttccacaccccaatctcttatctctgtgccccaatcccttatttccgtgccccaaccccccttcccgcttttctggagggtaacaaccccgaaccccttccctccatgtctctacgctctcttttctctgggtttacctccttcactatgggcaaccttccatcctccattcctcctccttctcgcttagcctgtcctcaagaacttaaaacctcttcaactcacacctgacctaaaacctaaatgcattattttcttctgcaacaccacttggccccaatacaaacttgacaatggctctaaatggccagaaaagggcactttcgatttctccatcctacaagacctaaataatttttgtagaaaaatgggcaaatggtctgaggtgccttacgtccaggcatttttcacacttcactccctccctagcctctgttcccaatgcgattcctcccagatcctcctttccctcctgcctatcccctcagtcccaaccccaagcgtcgctgagtttttccagtcttccttttctacagacccatctgacctttcccctcctccccaggctgctcgtcgccaggccgagctaagtcccaattcttcctcagccccaactcctccaccctataatccttctatcacctcccctcctcacacctggtctggcttacagtttagttccgcgactagctcttccccacctgcccagcaatttactcttaaaaagatggctagagctaaaggcatagtcaaggttaatgctcctttttctttatcccaaatcagatagcatttaggctctttttcatcaaatataaaaatccagcccagttcatggctcgtttggcagcaactctgagacgctttacagccctagaccctaaaaggtcaaaaggccgtcttattctcaatatacattttattacccaatctgctcccaacattaaataaaactccaaaaattagaatctggcactcaaaccccacaacaggacttaattaacctcaccttcaaggtgtacgataatagaataaagttgcaattccttgcctccactgtgagacaaaccccagccacatctccagcacacaagaacttccaaacgcccgaaccgcagcggccaggggttcctccagaacctcctcccccaggagcttactacaagtgccagaaatctggccaccaggccaaggaatgcccacagcccaggattcctcctaagccgtgtcccatctgtgcgggaccccactgaaaaatcggactgttcaactcacctggtagccacttccagagcccctggaactctggcccaaggctctctgactccttcccagatcttctcagcttagcggctgaagactgacactgcccaatcgcctcggaagccccctagaccatcacggatgccaagcttcgggtaactctcacagtggaggttaagtccgtcccttcttaatcaatacggaggctacctgctccacattaccttcttttcaagggcctgtttcccttgcttccataactgttgtgggtattgacggccaggcttctaaacctcttaaaactccccaactctcgtgccaacttggacaacactcttttatgcactctttgttagttatccccacctgcccagttcccttattaggccgagatattttaaccaaattatctgcttccctgactattcctggactacagccacatctcattgccgcccttctccccaacccaaagcctccttcgtgtcttcctctcatatccccccaccttaacccacaagtatgggacatctctactccttccctggcaaccgatctcatgcccattaccatcccattaaaatctaatcacctttaccccactcaacgccaatatcccatcccacagcatgctttaaaaggattaaagcctgttaccactcgcctgctacagcatgggcttctaaaacctataaactctccttaccattcccccattttacctctcctaaaacgagacaaggcttacaggttagttcagaatctgcaccttatcaaccaaattgttttgcctatccaccccgtggtgccaaacccatatactctcctatcctcaatacctccctctactacccattattctgttctggatctcaaacatgctttctttactattcctttgcacgcttcatcccagcctctctttgccttcacttagactgaccctgacacccattaggctcagcaaattgactgggctgtactgccgcaaggcttcacagacagcccccattacttcagtcaagcccaaatttcatcctcatctgttacctatctcggcataattctcgtaaaaacacacgtgctctccctgctgatcgtgtccgattaatctcccaaacctcaatcccttactaaagaacaactcctttccttcctaggcatggttagtgcggtcagaattcttacacaagagccaggaccacaccgggtagcctttctgtccaaacaacttgaccttactgttttagcctagccctcatgtctgcatgcagtggctgccgctgctttaatactgttagaggccctaaaaatcacaaactatgctcaactcattctctacatttctcataacttccaaaatctattttcttctcacacctgacgcatatactttctgctccccggctccttcagctgtactcactctttgttaagtcccacaattaccattgttcctggcccggacttcaatccggcctcccacattattcctgataccacacctgacccccatgactgtatctctctgatccacctgatattcaccccatttccccgtatttccttctttcctgttcctcaccccgatcacacttgatttattgatggcagttccaccaggcctaatcgccacacaccagcaaaggcaggctatgctatagtacaaaccactaccccgcctctcagaacctctcatttcctttccatcatggaaatctatcctcaaggaaataacttctcagtgttccatctgctattctactactcctcagggattattcaggccccctctcttccctacacatcaagctcgaggatttgccccgacccaggactggcaaattagctttactcaacatgtcccgagtcaggaaactaaaatacctcttagtctaaatagacactttcactgaataagtagaggcctttcctacagggtctgagaaggacaccacagtcatttcttcccttctgtcagacataattcctcagtttagccttcccacctctatacagtctgataacagactagcctttattagtcaaattagccaagcagtttttcaggctcttagtattcagtgaaatctttatatcccttatggtcctctgtcttcaagaaaattagaatggacaaaaggtcttttaaaaacacacctcaccaagctcagccaccaacttaaaaaggactggacaatacttttaccactttcgcttctcagaagtcagacctgtcctcaaaatgctacagggcacagcccatttaagctcctgtatagacactcctttttattaggccccagtctcattcgacaccagaccaacttagactgtgccccaaaaaaacttgtcatccgtactatcttttgtctagtcatactcctattcaccgttctcaactactcatacatgccctgctcttgtttacactgccggtttacgctgtttctccaagccatcacagctgatatctcctggtgctatccccaaactgccactctaaactcttgaagtaaataaataatctttgctggcaggactatgctgaatctccttaggcactctctaatcagatgtcctaggccctcccaattcttagaccttttatacctgtttttctccttctcttattccatttagtttctcaattcatacaaaaccgtatccagcccatcaccaatcattctatatgacaaatgtttcttcttacatccccacaataccaccccttaccacaagacctcccttcagcttaatctctcccactctaggttcccacgccacccctaatcccacttgaagcagccctgagaaacatcgcccattctctctccataccacccccccaaaattttcgctgccccaacacttcaacactattttgttttatttttcttattaatataagaaggcaggaatgtcaggcctctgagcccaagccaagccatcgcatcccctgtgacttgcacgtatacacccagatggcccgaagtaactgaagatccacaaaagaagtaaaaatagccttaactgatgacattccgccattgtgatttgttcctgccccaccctaactgatcaatgtactttgtaatctcccccacccttaagaaggttctttgtaattctccccacccttgagaatgtactttgtgagatccacccctgcccgcaaaacattgctcttaacttcaccgcctgacccaaaacctataagaactaatgataatccatctccctttgctgactctcttttcggactcagcccacctgcatccaggtgaaataaacagccgtgttgctcacacaaagcctgtttggtggtctcttcacacggacgcgcatgaaa

SEQ ID NO: 482 - DNA, 634 bp, Homo sapiens
ctacagcaggtagttagagatgagcagggcaggagaaccctcctcccacccccaggaatgtcaggcaatcataagatgagggtcaagccgttgttaaactgcctcgctaaagtaataattagttgcagctggtgccagggacggaccgtcttccagtagatagaaaacacctgaaactggtgatcagctgctttctgataagacctcaggaattaggcgagtgggctcaagcatgcgcactaacaggcatagcggaagagttaaaaatgcctcaaataagcatgcgtaaaactttagtaaacacactgcacattcagtccctcccaagtgctggccggccactgtgcatgcgaacagcctacctcaaggtaagcatcaggcaagaaggaacacaacccctgcgccccccccaaggaatcatgccaaaatataaaaccgtaagtctaaagtcaaacggtgcacttgaatctctcgttgcccacttgaccctcttccaggcgtactttacttcctttcatccccactctaaagctttttaacaaactttcacccctgctctaaaacttgcctcagcatctctttcagccttagtcccctcagttgaattctttcttctgaggagacaaaaattgag

SEQ ID NO: 483 - DNA, 440 bp, Homo sapiens
gtcaggcctctgagcccaggccaggccatcgcatcccctgtgacttgcacgtatacatccagatggcctgaagtaactgaagatccacaaaagaagtaaaaacagccttaactgatgacattccaccattgtgatttgttcctgccccaccctaactgatcaatgtactttataatctcccccacccttaagaaggttctttgtaattctccccagccttgagaatgtactttgtgagatccactcctgcccacgagagaacaaccccctttgactgtaattttccattaccttcccaaatcctataaaatggccccacccctatctcccttctctgactctcttttgggactcagccctcctgcacccaggtgaaataaacagccatgttgctcacacaaagcctgtttggtggtctcctcacacggacgcacatgaaa

SEQ ID NO: 484 - DNA, 1465 bp, Homo sapiens
tgttatcactctcctgctacagcatggtcttttaaagcatataaactctccttacaattccccctttttacctgtcctaaagccagacaagccttacaggttagttcaggatctgcgccttatcaaccgaattgttttgcctatccaccccatggtggtgccaaacccatgtactctcctatcctcaatacctccctccacaacccattattctgctctagatctcaaacatgctttctttactattcctttgcacccttcatcccagcctctcttcactttcacttggactgaccctgacacccatcaggctcagcaaattacctgggctgtactgccgcaaggcttcacagacagctcccattacttcagtcaagcccaaatttcatcctcatctgttacctatctcggcataattctcataaaaacacacgtgctctccctgctgattgtgtcccgctaatctcccaaacctcaatcccttctacaaaacagcaactcctttccttcctaggcatggttaatgcagtcagaattcttacacaagagccaggaccacgccctgtagcctttctgtccaaacaacttgaccttactattttagcctagccctcatgtctgcatgcagcggctgccactgctttaatacttttagaagccccaaaaatcacaaactatgctcaacttactctctacagttctcctaacttccaaaatctattttcttcctcacacctgacgcatatactttctgctccccggctccttcagctgtactcactctttgttgagtctcccacaattaccattgttcctggcccagacttcaatccggcctcccacattattcctgataccacacctgaacctcatgactgtatctctctgatccacctgacattcaccccatttccccatatttccttctttcctgttcctcaccctgatcacacttggtttactgatggcagttccaccaggcctaatcaccacacactagcaaaggcaggctatgctatagtacaagccactagcctgcctcttagaacctctcatttcctttccatcgtggaaatctatcctcaaagaaatcacttctcaatgttccatctgctattctactacccctcaaggattgctcaggccccctccctttcctacacatcaagctcgaggatttgcccccgcccaggactggcaaactgtgaaattccttttcctggctcatcctggctcaaaagctcccccactgagaaccttgtgaccccacccctccccaccagagaacatccccctttgactgtaattttcctttacctacccaaatcctataaatcggccccacccctatctcccttcgctgactcacttttcagactcagctcgcctgcacccaggtgattaaaaagctttattgctcacacaaagcctgtttggtggtctcttctcaccaacgcgagtgaaa

SEQ ID NO: 485 - DNA, 5880 bp, Homo sapiens
gtcaggcctctgagcccaagccaagccatcacatcccctgtgacttgcacgtatacgcccagatggcctgaagaaactgaagaatcacaaaagaagtgagtatgccctggcccaccttaattgatgacattccaccacaaaagaagtgtaaatggccagtccttgccttaagtgatgacattaccttgtgaaagtccttttcctggctcatcctggctcaaaaagcacccccactgagcaccttgcgacccctactcctgcccgcgagagaacaaaccccctttgactgtaattttcctttacccacccaaatcctataaaacagccccacccttatctccctttcgctgactctcttattttcacctgcctgcacccaggtgaaataaatagccatgttgctcacacaaagcctgtttggtggtctcttcacacagacgtgcatgaaatttggcgccgtgactcggattgggggaactcccctgggagatcaatcccctgtcctcttgttctttgctccatgagaaagatccacctacgacctcaggtcctcagactgaccagcccaaggaacatctcaccaattttaaatcaggtaggtggcctcttcttactctcttctccaacctctctcactgtccctcaaccactttcttctttccactcttcaatctctcccttctcttaatttcaattcctttcattttctgggagagacaaaggagacacgttttatctgtggacccaaaactccggcgccagtcacagactgggaaggcaggcttcccttggtgtttaatcattgcagggatgcctctctgattattcacccacgtttcaaaggtgtcagaccacgcagggacgcctgccttggtccttcacgcttagcagcaagtcccgcttttctggggaagaggcaagtaccccaaccccttctctccttgtctctaccccttctctcctttcctggggcaggggcaagtacccctcaaccccttctccttcacccttagtggcaagtcctgcttttctgggtgaggggcaagtacccctcaaccccttctccttcacccttagtggcaagtcccgcttttctgggggaggggcaagtacccctcaaccccttctctttcacccttagcggcaagtcccgcttttctagggggcaagaacccccaatcccttatttccgcaccccaacctcgtatctctgtgccccaatcccttatttccatgccctgaccccttatttccatgccccaaccccttatttccatgccctgacctcttatctctgtgccctaaccccttttcccacttttctggaagggaagaacccccaaaccccttccctccatttctctactctcttctctaggcttgcttccttcactataggcaaccttccaccctccattcctccttctactcccttggcctgtgttctcaaaaacttaaaatctcttcaactcacaactgacctaaaacctaaatgccttattttcttctgcaatgccacttgaccccaatacaaactcgactgtagttccaaatagccagaaaatggcactttgaatttttccatcctgcaagatctaaataattcttgtcctaaaataggcaaacagtctgaggtgcctgacgtccaggcattcttttacacatcagtcccttccttgtctctgtgcccagtgcaaatcatcccaaatcttccttctttccctcccgcctgtcccctaagtcccaaacccaagcatcgatgagtctttctaatcttccttttctacagacccatctgacctctcccctccttgccaggcctagctaggtcccaatgcttcctcagcctccgctcctccaccctataatctttttatcgcctcccctcctcacacctggtctggcttacagtttcgttcttgactagccctcccccacctgcccagcaatttactcttaaaaaggtggctggagccaaaggcatagtcaaggttaatgctcctttttctttatcccaaatcggatagcgtttaggctctttttcatcaaatataaaaatccagcccagttcatgacttgtttggcagcaaccctgagacactttacagccctagaccctaaaaagtcaaaaggccgtcttattctcaaaatacattttattacccaatctgctcccgacattaaataaaactccaaaaattaaattctggccctcaaaccccacaacaggatttaattaacctcaccttcaaggtgtacaatgatagaaaaaagttgcaattccttgcctccactgtgagacaaaccccagccacatctccagcacacaagaacttccaaacacctgaaccgcagcggccaggcattcctctagaacctcctcccacaggagcttgctacatgtgccggaaatctggcctctgggccaaggaatgcccgcagcccgggattcctcctaagccacgtcccatctctgtgggaccccactgaaaatcggactgttcaactcacctggcagccactcccagagcccctggaactctggcccaaggctctctgactgactccttcccagatcttctcggcttagcagctgaagactgacactgcccgatcgccttggaagccccctagaccatcacggacgccaagcttcaggtaactctcacagtggaaggtaagcccgtccccttcttaatcaatacggaggctacccactccacattaccttcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggctgagacactttaactaaattatctgcttccctgactattcctggactacagctatatctcattgccgcccttcttcccaatccaaagcctcctttgcatcctcctcttgtatccaccccccttaacccacaagtataagatacctctactccctccttggcgaccgatcatgcaccccttaccatctcattaaaacctaatcacccttaccccactcaatgccaatatcccatcccgcagcatgctttaaaaagattaaagcctgttatcactcgcctgctacagcatggccttttaaagcctataaactctccttacaattcccccattttacctgtcctaaaaccagacaagccttacaagttagttcaggatctgcaccttatcaaccaaattgttttgcctatccaccccgtggtgccaaacccatatactctcctatcctcaatacctgcctctataacccattattctcttctagatctcaaacatgctttctttactattcctttgcacccttaataccagcctctcttcactttcacttggactgaccctgacacccatcaagctcagcaaattacctaggctgtactgctgcaaagcttcacagacagcccccattacttcaatcaagcccaaatttcttcctcatctgttacctatctcggcataattctcataaatcacacgtgctctccctgccaatcgtgtccgactgatctctcaaaccccagcaccttctacaaaacaacaactcctttccttcctaggcatggttagcatggtctgaattcttacacaggagccaggaccacaccctttagcctttctgtccaaacaacttgaccttactgttttagcctagccctcatgtctgcgtgcagtggctgctgctgctttaatacttttagaggccctaaaaatcacaaactatgttcaactcactctctatagttctcataacttccaaaatctatttgcttcctcatacctgatgcatatactttctgcttcctggctccttcagctatactcactctttgttgagtctcccacaattaccgttgttcctggcccagacttcaatccggtctcccacattattcctgataccacacctgacccccatgactgtatctctctgatccacctgacattcaccccatttccccaaatttccttctttcctgttcctcaccctgatcacgcttgatttagtgatggcgattccaccaggcctaatcgacacacaccagcaaaggcaggttatgctatagaacaagccactagcccgcctctcagaacctctcatttcctttccatcgtggaaatctatcctcaaggaaataacttctcagtgttccatctgctattctactactcctcagggattattcaggccccctcccttccctacacatcaagctcgaggatttgccccacccaggactggcaaattagctttactcaacatgccctgagtcggataactaaaatacctcttagtctagttagatactttcactggataggtagaggcctttcctacagggtctgagaaggccaccacagtcatttcttcccttctgtcagacataattcctcagtttagccttcccacctcaatacagtctgataacagacgagcctttattagtcaaatcagccaagcagtttttcaggctcttagtattcagtgaaacctttatatcccttacggtcctctgtcttcaagaaaagtagaatggactaaaggtcttttaaaaacacacctcaccaagctcagccaccaacttaaaaaggactggacaatacttttaccactttcccttctcagaattcaggcccgtccttggaatgctgcagggtacagcccatttgagctcctgtatagacgctcctttttattaggccccagtctcattctagacaccagaccaagttagactgtgccccaaaaaaacttgtcatccctactatcttctgtctagtcatactcctattcaccgttctcaactactcatacatgccctgctcttgtttacactgccagtttacactgtttttccaagccatcacagctgatatctcctggtgctatccccaaactgccactcttaactcttgaagtaaataaataatctttgctggcaggactatgctgaatctctttaggcactgtctaatcagatgtcctgagtcgtcccaattcttcgatcttttatacctgtttttctccttctgttattccatttagtttctcaattcatccaaaaccgtatccaggccatcaccaatcattctataagacaaatgtttcttctaacatccccacaatatcaccccttaccacaagacctcccttcagcttaatctctcccactctaggttcccacgccgcccctaatcccacttgaagcagccctgagaaacatcgcccattctctctccgtaccaccccccaaaaattttcaccgccccaacacttcaacaccattttgttttatttttcttattaatataagaaggcaggaatgtcaggcctctgagcccaagccaagccatcacatcccctgtgacttgcacgtatacacccagatggcctgaagtaactgaagaatcacaaaagaagtgaatatgccctgccccaccttaactgatgacattccaccacaaaagaagtgtaaatggccggtccttgccttaagtgatgacattaccttgtgaaagtccttttcctggctcatcctggctcaaaagcacccccacagagcactttgtgacccccactcctgcccgccagagaataaaccctctttgactgtaattttcctttacctacccgaatcctatgaaatggctccacccttatctcccttcgctgactctcttcggactcagcccacctgcacccaggtgaaataaacagccatgttgctcacacaaagcctgtttggtggtctcttcacacggacatgcatgaaa

SEQ ID NO: 486 - DNA, 6042 bp, Homo sapiens
gccaggcctctgagcccaagctaagccatcatatcccctgtgacctgcatgtacacatccagatggccggttcctgccttaactgatgacattccaccacaaaagaaatgaaagtggcctgttcctgccttaactgatgacattatcttgtgaaattccttctcctggctcatcctggctcaaaagctcccctactgagcaccttgtgaccgccccccctgcccgccagagaacaacccccctttgactgtaattttcctttacctacccaaatcttataaaacggccccacccctatctcccttggctgactctcttttcggactcagcccgcctgcacctaggtgaaataaacagccttgttgctcacacaaagcctgtttggtggtctcttcacacagacgcgcatgaaatttggtgctgtgactcagattggaggacctcccttgggagatcaatcccctgtcctcctgctctttgctctgtgaaaaagatccacctacgacctcgggtcctcagacccaccagcccaaggaacatctcgccaattttaaatcgggtaagcggcctcttcttactctcttctccaacctctctcactatccctcaaccactttctcctttcaatcttggcgccacccttcaatctctccctctcttactttcaattcctttcattttctggtagagacaaaggagacacattttatccttggacccaaaactctggcgccagtcacggactaaggaaggcagccttcccttggtgtttaatcattgcagggacacctctctgatttttcacccatgtttcagaggtgtctgaccacatggggacacctgccttggtccttcacccttagcagcaagtactgcttttctagggggcaagaaccccccaaccccttctctccatgtctctactcctctgcttttctagagggcaagaacccccccaaccccttctccttcacccttagctgcaagtaccacttttctagggggcaagaaccccccaaccccttctctccgtgtctctaccccttctctgcttttctgggggcaagaacccccgatcccttatttctgtgccccaacctcttatctctgtgccccatcccttatttccacgccctgaccccttatctctgagccccgatcccttatttccatgccccgacctcttatctctgcgccccgatcccttatttccgcaccccaacctcttatctctgtgccccgatcccttatttccacaccgcaatcccttatttccgcaccctgacctcttatctctgcaccccaaccccttatttctgtgccccgacccctttcctgcttttctggagggtaagaacccccgaaccccttccctccgtgtctctactctcttttctctgggcttgcttccttcactatgggcaaccttccaccctccattcctcctccttctcccttagcctgtgttcttaagaacttaaaacctcttcaactctcacctgacctaaaatctaagcatcttattttcttctgcaatgctgcttgaccccaatacaaactcaacagtagttccaaatagccagaaaatggcacttttaatttttccatcctacaagatctaaataattcttgtcataaattaggcaaatggtctgaggtgcctgacgtccaggcattcttttacacatcggttcctccctggtctctgttcccaatgcaaccagtcccaaatcttccttctttccctcccacctgtcccctcagtcccaaccccaagcatcactgagtctttctaatcttccttttctacagacccatctgacctctcccctcctcaccaggcagagccaggtcccaattcttcctcagcctctgctcccccaccctataatccttttatcacctcccctcctcacaccttgtccggcttacagtttcattcctcaaccagccttcccccacctgcccagcaatttcctcttaaaaagatggctggatataaaggcatagtcaaggttaacgctcctttttctttatccgacctctcccaaaatcagttagcgtttaggctctttttcatcaaatatgagaaacccagcccagttcatggctcgtttggcagcaaccctgagacgctttacagccctagaccctgaaaggtcagaaggccatcttattctcaatatgcattttattttattacccaatctgctcccgacattaaataaaactccaaaaattaaattccagccctcaaaccccacaacaggacctaattaacctggccttcaaggtgtacaataatagagtagaggcagccaagtagcaatatatttctgagttgcaattccttgcctccactgtgagacaaaccccagccacatctccagcacaaaagaacttccaaacgcctaagtcgcagtggccaggcgttcccccaggcccgcctcccccaggagcttgctacaagtgccagaaatctggccaccaggccaaggaatgcccgcagcccacgattcctcctaagccgcgtcccatctgtgcaggaccccactgaaaatcagactgttcaactcacctggcaaccagtcccacagcccctagaactctggcccaaggctctctgactgactccttcccagatcttctcggcttagcagctgaagactgaaactgcccgattacctcagaagcttacaggaccatcacagatgctctaggtaactcttacagtggaaggtaagccgtccccttcttaatcaatatggaggctacccactccacattaccttcttttcaagggcctgtttcccttgcctccataactgttgtaggtattggcggccaggcttctaaacctcttaaaactccccaactctggtgccaacttagacaatactcttttaagcactcctttttagttatccccacctgcccagttcccctattaggctgagacactttaactaaattatctgcttccctgactgttcctaggctacagccacacctcattgccaccttttcccccagttcaaagcctccttcacatcctccccttgtatctccccaccttaacccacaagtataagacacctctactccctccttagcaaccaatcatccaccccttaccatctcattaaaacctaatcactcttaccccgctcaatgccaatatcccatcccacagcacactttaaaaggattaaagcctgttatcactcacctgttacagcaaggccttttaaagcctataaactctccttacaattcccccattttacctgtccaaaaaccagacaagccttacaggttaattcaggatctgcaccttaccaaccaaattgttttgcctatctaccctgtggtgccaaacccatatactctcctatcctcaatacctccctccacaacccattattctgttctagatctcaaacatgctttctttactattcctttgcacccttcatcccagcctctcttcgctttcacttggactgaccctgacacccatcaggctcagcaaattacctgggctgtactgccacaaagcttcacagacagcccccattacttcagtcaagcgcaaatttcttcctcatctgttacctatctcggcgtaattctcataaaaacacatgtgctctccctgctgatcatgtccagctgatctctcaaaccccaacaccttctacaaaacaacaactcctttccttcctaggcatagttagatacttttgactttagatacctggttttgccatcctaacaaaaccattatataaactcacaaaaagaaacctagctgacccatagattctaaatcctttccccactcctctttccattccttgaagacagctttagagactgcccccaccctagctctccctgactcatctcaacccttttcattacccacagctgaagtgcagggctgtgcagtcagaattcttacataaggaccaggatcacgtcctgtagcctttttgtccaaacaacttcaccttcctgttttaggctggccatcctgtctccgtgcagtggctgctgccgccctaatactttagaggcccttaatataacaaactatgctcaactcactctctacagttctcataacttccaaaatctattttcttcttcacacctgacacatatattttctgctccccggctccttcagctgtactcactctttgttaagtctcccacaattaccactgttcctggcccagacttcaatccggcctcccacattattcctgataccacacctgtcccctatgactgtatctctctgatccacctgacattcaccccatttccccatatttccttctttcctgttcctcaccctgatcacacttggtttattgatggcagttccaccaggcctaatggccacacaccagcaaaggcaggctatgctatagtacaagccactagcccacttcttagaacctctcatttcctttccatcatggcaatctatcctcaaggaaataacttctcagtgttctatctgctattctactactcctcaaggattattcaggccccctcccttccctacacatcaagctcggagatttgcccctacccaggactggcaaattggctttactcaacatgccccgagtcagaaaacaaaaatacctcttagtctaagtagacactttcactggataagtaaaggcctttcctacaaggtctgagaaggccactgctgtcatttcttcccttctgtcagacataattcctcggtttggccttcccacctctatacagtccaatagcagactggcctttattagtcaaatcagccaagcattttttcaggctcttagtattcagtgaaacctttatatcccttacagtcctcagtcttcaggaaaggtagaacggactaatggtcttttaaaacctcaccaaactcagccaccaacttaaaaaggactggacaatacttttaccactctccgttctcagaattcaggcctgtcctcagaatactacagggtacagcccatttgagctcttgtatagatgctcctttttattaagccccagtctcattccagacacaagaccaacttggactgtgccccaaaaaacttgtcatccctactatcttctgtctagtcatactcctattcactgttctcaactactcatacatgccctgctcttgtttacactgccagtttacactgtttctccaagccatcacagctgatattggtgctatccccaaactgccactcttaactcttaaagtaaatgaataatctttgctggcaggactatgctgaatctccttaggcactctctaattagatgtcctaagtcctcccaattcttagacctttaatacctgtttttctccttctcttattccgtttagtttttcaattcatacaaaaccatatccaggccatcaccaataattctaaatgtttcttctaacaatcccacgatatcaccccttaccacaaaatcttcagcttaatctctcccagtctaggttcccatgccgcccctaatcccgctcgaagcagccctgagaaacatcgcccattatctctccataccacccccaaaaatttttgccatcccaacactttaccactatttcgttttatttttcttattgatataagaagacaggaatgtcaggcctctgagcccaagctaagccatcatatcccctgtgacctgcatgtacacatccagatggccagttcctgccttaactgatgacattatcttgtgaaattccttctcctggctcttcctggctcaaaagctcccctactgaccaccttgtgacccccactcctgcccaccagagaacaacccccctttgactgtaattttcctttacctacccaaatcttataaaacggccccatccctatctcccttggctgactctcttttcggactcagcctgcctgcacccaggtgaaataaacaaccttgttgctcacacaaagcctgtttggtggtctcttcacatggacgcgcatgaaa

SEQ ID NO: 487 - DNA, 223 bp, Homo sapiens
gtcaggcctctgagcccaagataagccatcatatcccctgtgacctgcacctacacatccagatggcctgttcctgccttaactgatgacattccaccacaaaggacaggaaaatggcctgttcctgccttaactgatgacattagcttgtgaaattccttctcttggctcatcctggctcaaaagctcccccactgagcaccttgtgaccccgcccctgccc

SEQ ID NO: 488 - DNA, 713 bp, Homo sapiens
aagggacagcactagctggatttcctaggcagactaagaatccctaagcctagctgggaaggtgaccgcatccacctttaaacacgggtcttgcaacttagctcacacccgaccaatcaggtagtaatgagagctcactaaaatgctaattaggcaaaaacagaaggtaaagaaatagccaatcatctatcgcctgagagcacagggggagggacaatgatcaggatataaacccaggcattccagccaacaagggcaaccccctttgggtgccctcccattttatgggagctctgttttcactctattaaatcttgcaactgcacactcttctgggccgtgtttgttatggctcgagctgagctttcactcaccctccaccactgctgatcgccgctgtcacagaccagccctgacttccacccctccggatccagcagggtgtccgctgcacttctgatctagtgaggaggtgcccattgccgctcccaatcggtctagaggctcgccattgttcctgtgcgggctaagtgccgggggttcgtcctaatcgagctgaatagagccataatgctcaccgcatggcccaagattccattccttggaatctgtgaggccaagaaccccaggtcagagaacgagaggcttgccgccatcttggaagcagcccgcagccatcttgggagttctaagaacaaggatccccggtaaca

SEQ ID NO: 489 - DNA, 991 bp, Homo sapiens
gtagggaaaagagagatcagactgttactgtgtctatgtagaaagggaagacataagaaactccattttgacctgtaccctgaaaaattgctctgccctgagatgctgttaatctgtaactgccccaacctctttgccccaaccttaagctcacaaaaacatgtgttgtatggaatcaaggtttaagggatctagggctgtgcaggatgtgccttgttaacaaaatgtttacaggcagtatgctcggtaaaagtcattgccattctccagtctcaataaaccaggggcacaatgcactgcagaaagccgcagggacctctgccctggaaagccgggtattgtccaaggtctttccccatgtgatagtctgaaatatggcctcgtgggatgggaaagacctgaccatcccccagcccgacacccgtgaagggtctgtgctgaggaggattagtaaaagaggaaagtcccttgcagttgagatagaggaaggccactgtctcctgcctgcccctgggaactgaatgtctcagtataaaacccgattgtacatttgttcagttctgagataggagaaaaaccgccctgtggcgggaggcgagacatgttggcagcaatgctgctttattattctttattccactgagatgtttgggtggagagaagcaaaaatctggcctacgtgcacgtccaggcatagtacctccccttgaacttatttgtgacacagattcctttgctcacatgttttcttgctgaccttctccccactatcaccctgctctcctactgcattcctcttattgagatagtgaaaatagtaatcaataaatactgagggaactcagagactggtgccggtgagggtcctccgtatgctgagcgctggtcccctgggcccactgttctttctctgtactttgcctctgtgtcttatttcttttctcagtctctcgtcccacctgacgagaaatacccacaggtgtagaggggc

SEQ ID NO: 490 - DNA, 5868 bp, Homo sapiens
gtcaggcctctgagcccaagccaagccatctcatcccctgtgacttgcacgtatacgcccagatggcctgaagtaactgaagattcacaaaagaagtgaatatgccctgccccaccttaactgatgacattccaccacaaaagaagtgtaaatggccggtccttgccttaactgatgacattaccttgtgaaagtcctttccctagctcatcctggcacaaaaaagcacccccactgagcaccttgcgacccccactcctgcccgccagagaacaaaccccctttgactgtaattttcctttacctacccaaatcctataaaaaggccccacccttatctcccttccctgactctcttttcggactcagcccacctgcacccaggtgaaataaacagccatgttgctcacacaaagcctgtttggtggtctcttcacatggacgcgcatgaaatttggtgccgtgactcagatcgggggacctcccttgggagatcaatcccctgtcctcctgttctttgctccatgagaaagatccacctatgacctcaggtcctaagaccaaccagcccaaggaacatctcaccaattttaaatcaggtaagcggcctcttcttactctcttctccaacctctctcactgtccctcaaccactttctcctttccactcttcaatctctcccttctcttaatttcaattcctttcattttctgggagagacaaaggagacacgttttatccgtggacccaaaactccggtgccagtcacggactgggaaggcagacttcccttggtgtttaatcattacagggacacttctctgattattcacccacgattcaaaggtgtcagaccacgcagggacgcctgccttggtccttcacccttagcggcaagtcccacttttctgggaaaggggcaagtaccccaaccccttctctccttgtctctaccccttctctgcttttctgggggaggggcaagtacccctcaaccccttctccttcactctgagcagcaagtcctgcttttctagaggaggggcaagtaccccaacctcgtatctctgtgccccaatcccttatttccgtgccccaacctcttatatctctgcaccccaatcccttatttccatgccccgagcccttatttctgtgccctgaccccttatttccatgcacctaccccttatttccatgccccaaccccttatctctgtgccccatcccttatttctgtgccccgacctcttatctctgcgccccaaccccttttcccacttttctggaaggtaagaacccccgaaccccttccctcctttccctactctctcttttctctaggcttgcttccttcactataggcaaccttccaccctccattcctccttctactcccttggcctgtgttctcaaaaacttaaaacctcttcaactcatacctgacctaaaacctaaatgccttattttcttctgcaatgccgcttcaccccaataccaactcgacagtagttccaaatagccagaaaatggcactttgaatttttccatcctgcaaaatctaaataattcttgtcataaaataggcaaatggtctgaggtgcctgacgtccaggcattcttttacacatcagtcccttcctagtctctgtgcccagtgcaactcatccgaaatcttccttctttccctcccgcctgtcccctctgtaccaaccccaagcgttgctgagtctttctaatcttccttttctacagacccatctgacctctcccttcctccccaggctgctcctcgccaggccgagctaggtcccaattcttcctcagcctccgctcctccaccctataatctttttatcacctcccctcttcacatctggtccggcttacagtttcgtaccatgactagccctccccctcctgcccagcaatttactcttaaaaaggtggctggagctaaaggcatagtcaaggttaatactcctttttctttatcccaaatcagatagcgtttaggctctttttcatcaaatataaaaatccagcccagttcatgacttctttggcagcaaccctgagacactttacagccctagaccctaaaaggtcaaaaggccatcttattctcaaagtacattttattacccaatctgctcccgacattaaataaaactccaaaaattaaattccggccctcaaaccccacaacaggatttaattaacctcgccttcaaggtgtacaataatagaaaaaagttgcaattccttgcctccactctgagacaaactccagccacatctccagcacacaagaacttccaaacgcctgaaccgcagcggccaagcattcctccagaacctcctcccacaggagcttgctacatgtgccagaaatctggccactgggccaaggaatgcccgcagcgccggattcctcctaagccgcgtcccatctatgtgggaccccactgaaaatcggactgttcaactcacctggcagccattcccagagcccctggaactctggcccaaggctctctgactgactccttcccagatcttctcggcttagcggctgaagactgacactgcccgattgcctcggaagcccccctagaccatcacagacgccgagcttcgggtaactctcacagtggaaggtaagcccgtccccttcttaatcaatacggaggctacccactccacattaccttcttttcaagggcctgtttcccttgcctccataactgttgtgggtattgacggccaggcttctaaacctcttaaaactccccaactctggtgccaacttagacaatactcttttaaacattcctttttagttatccccacctgcccagttcccttattaggctgagacactttaactaaattatctgcttccctgactattcctggactacagctaaatctcattgcctcccttcttcccaatccaaagcctcctttgcgtcctcctcctgtattcccccaccttaacccacaagtataagatacctctactccctccttggtgaccgatcatgcgccccttaccatctcattaaaacctaatcacccttaccccactcaacgccaatatcccatcccgcagcacgccttaaaaagattaaagcctgttatcactcgcctgctacagcatggccgtttaaagcctataaactctccttacaatttccccattttacctgtcctaaaaccagacaagccttacaagttagttcaggatctgcaccttatcaaccaaattgttttgcctatccaccccgtggtgccaaatccatatactctcctatcctcaatacctgcctctacaacccattattctgttctggatctcaaacatgctttctttactattcctttgcacccttaattccagcctctcttcactttcacttggactgaccctgacacccatcaagctcagcaaattacctaggctgtactgccacaaagcttcacagacagcccccattacttcaatcaagcccaaatttcttcctcatctgttacctatctcggcataattctcataaaaacacacgtgctctccctgccaatcgtgtccgaatgatctctcaaaccccagcaccttctacaaaacaacaactcctttccttcctaggcatggttagcgcggtcagaattcttacacaagagccaggaccacaccctgtagcctttctgtccaaacaacttgaccttactgttttagcctagccctcatgcctgtgtgcagcagctgccgctgctttaatacttttagaggccctcaaaatcacaaactatgctcaactcactctctacagttctcataacttccaaaatctattttcttcctcatacctgacgcatatactttctgctttctggctccttcagctatactcactctttgttgagtctcccacaattaccattgttcctggcctggacttcaatccggcctcccacattattcctgataccgcacctgacccccatgactgtatctctctgatccacctgacattcaccccatttccccaaatttccttctttcctgttcctcaccctgatcacgcttgatttattgatggcggttccaccaggcctaatcgccacacaccagcaaaggcaggttatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagctcgaggatttgcccccacccaggactggcaaattagctttactcaacatgccctagtcaggaaactaaaatacctcttagtctaaataaacactttcactgaataagtaaaggcctttcccacagggtctgagaaggccaccacagtcatttcttcccttctgtcagacataattcctcagtttagccttcccacctcaatacagtctgataacagatgagcctttattagtcaaatcagccaagcagtttttcaggctcttagtattcagtgaaacctttatatcccttatggtcctccgtcttcaagaaaagtagaattgactaaaggtcttttaaaaacacatctcaccaagcttagccaccaacttaaaaaggactggacaatacttttactactttcccgtctcagaattcaggcctgtccttggaatgctacagggtacagcctatttaagctcctgtatagacgctcctttttattaggccccagtctcattccggacaccagaccaacttagactgtgccccaaaaaacttgtcatccctactatcttctgtctagtcatactcctattcaccgttctcgactactcatacacgccctgctcttgtttacactgccggtttacactgtttttccaagccatcacagctgatatctcctggtgctatccccaaactgccactcttaactcttgaagtaaataaataatctttgctggcaggactatgccaaatctccttaagcactctctaatcagatatcctgagtcgtcccaattcttagaccttttatacctgtttttctccttctgttattccatttagtttttcaattcatacaaaaccatatccaggccatcatcaatcattctatacgacaaatgtttcttctaacatccccacaatatcaccccttaccacaagacctcccttcagcttaatctctcccactctaggttcccacgccgcccctaatcctgcctgaagcagccctgagaaacattgcccattctctctccataccaccccccaaaaattgtcaccgccccaacacttcaacattattttgttttatttttcttattaatataagaaggcaggaatgtcaggcctctgagcccaagccaagccatctcatcccctgtgacttgcacgtatatgcccagatggcctgaagtaactgaagattcacaaaagaagtgaatatgccctgccccaccttaactgatgacattccaccacaaaagaagtgtaaatggccggtccttgccttaattgatgacattaccttgtgaaagtccttttcctggctcattctggctcaaaaaagcacccccactgagcaccttgtgacccccactcctgcccgccagagaaaaaaccccctttgactgtaattttccattaccttcccaaatcctataaaacggccacaccctcatctcccttccctgactctcttttcggactcagcccgcctgcacccaggtgaaataaacagccatgttgctcacacaaagcctgtttggtggtctcttcacacagacgtgcatgaaa

SEQ ID NO: 491 - DNA, 4890 bp, Homo sapiens
ttagagtaggtagtcaggcagacatgagcagggcaggagagggcccccagctcaggaatgtcaggcgaccatcaggtgatgatcaggcggttgttacactgtttctctaaaataataataatgggttgcagccagtaccagggaaagacagtctcccaaaagacaggaaacaccggaagctggtgatcagcaacttcctgataagatctccgaagctgggcaagtgggctcaagcatgcgcactaagaagcaaaatgacagtttaaccagtatgtgaccttcctctaggaacacctgactgataagggaaaaatgtctcaagaaagcatgcgcacaacttcagtaaacaaatgcacatgtggctcctcccaagtgctgacaggccactgcacagcagacagcccaccccaaggaaaaaaatccaaggaggagaaatggaaaccccggaaccatgccgatgtataaaaccccaagtcaagggctgaacagggcacttggatctctcaaatggtgcagtgactcggataccttccctagtggtaagacacctctacgccttgccttcttcggctggaggcgttcaaccctcgtacgtggtttcgttctcctctttcactctcctgcttactaacctacccctggaacgattcctctcaaccacagtggctctgctccccctggctgctctctctgctcaccccgaaggatggcttgcaggggtgggaaggaccttggagtctgcactaagtagacctgagacactaatggcccccccagacaggaggctgatgagagcggtagggctaaaacctacaaccatgtagtatctggggtttcctctgctttttcaactaaaatcagctctttcccaaaaacccaccaccacctattttcctttctctgtatgtattccaaaatgacctcgcacacccattggaccaactgccttgggggtaagtctgtcttttctctgttcttactttgcatgccctgcaactttcttctctgccttaaacacacattccctatttgttattcatgcacccgcagctcttgctgtgttagcctggcaaccaagagatggactcccttacggatgtcccttgatatttatacttgttaccctaccagctcggatgacctccaaccctttccctgtctgttggctcactgccgggatagacactaatcagaaccttagctctgtcagctccttatgacttaccatatgcttttcatccctgttatgctccagggccatgtttctccctggcttttgaatggtttgcttgcttgcataggacctcactctgtagcccttaaggaccccacccactcgctttttttctgagttagcacccctttgtggggaaggaaaattctctgccgtttgcagggtcttatcccaaacaccaagtcctccagaggttcctcctttatatcaagagggcaaataaacgttgccctctcaaatccaagggctgctgtttctgcaaacatatgaaggctttccatgagtattcctcttgcttcctcccgctttctcctgtagcagagggattgttctacctcgttaagcatttgttctgcatgttaccctgggaggatgaagaatcccaaatacaaattttcctccattcctctaatcacctccaggcccttctcaatatgtatcaggaccttcaaagttatatttgaagggagagaagtccagcccccttgcagcaattggcagaaaaacaggcttctcgtcttcttaaagaacatgggaaatgagaatctgagaagagataatcattctgttgctagaatgctctgaacaagggtcactataaggtcatggagacaaggatataggacagcccaaggaggcagatgcaagagaccaaagtacccatagaacagagatgaagactagttccaggctacaaacacaaaacagattaccactgcaacacagatgaaggctggtccagaaatgggatgggatcagggtaggggtacccagtaaacactgggttcattccagaaccccttggatgagtgggagggcaccctgttcactgtagtctgccataggcacaggattaagagaacaaggggagatgccctcttctcgcctctgttctttctttacaaacgggtaattgtgcctcaataaaacaagatgggaccaaggttaggggtacctggtaagcactggttcattctggaacccctagaatgaatgggggacactgccatacgcaaaggaaaaatggatgaatggggtaatgccctacccactctggtctgctgtaagttcaggaaaaagacagtagggaaattggaggggttgccttctttttctcttctctcctctgttctctctgtggacaggtaatcaagtctctgtaccacaggacacactactaggatacatcctcaagaactgggaaaagtttgactcccaaaccctaaaaaggaaaaggctaatatttttctgtaatacagcctgggttgaataaaagctctaggaccaggaatcttggccagaaaatagaagcacaaatttaaatatgatccatcaactagatttgttttgctaccaccagggaaaatggacagaaatcccctatgtgctggccttcatggccctaagaaacaaccctgacctttgttgggcttgtaaaacagatccatggccatagtcatgcagccccttcccattggttcagaaggcccctcatcaggtttacccagagctcaagccccattgccccttctacccaattatatcgaagtctcccagaagccttctcctccctacccagggccatcctctggacaccacctccttaagttatgccccattcaggaggtttagtggtcccagtggacccactggagtccagactccattcactgtgcaagacctgagccaaattaaaatggaactagggaagtttatggaggaccctgacaaatatatcaaagtgttttataaactgggcttaacatctgaactcaccaggagggacctctcagtcatactagggcaaactctgcctaagggagaatgtgactccattatggtggcggtccaacaatttgcaaacacaatgcacatgcctgacactggtggctaccctgtgggggccaccatagttccccaggtcaaccccaattgggattacaatatccaggggagtacatgagcaaggacccacatgttcctctatctgatagaaggaatgaaagctagcagagcaaagcctgtgaactgtaataaattgggcttgacagatcaagggccttatgaaaacctcaccattttcttagacaggctagaagaggccctagtgaaacacactaacctagacccagacccactagaaggacaactgttcataaaggatcatttccctaactcaaacaacaccagatattaggaggaaacaccagaaactagcactggatcccagtacccctatgcctgacatctgcaaagtaggttccttggtcttttacaaccaaaaccaggaggagtaggaaagggctcaagaaaaggagaggcaaaaggaaaagcaacagctccaactactgactgccctgcaaacctgccagccacctctggcaggccccagggagatccctttgcccaaatgctacttctgtggggagccaggccacacaagaaggcagtgcccaaactgatggggacacccacccccagctctccatgctccaattgccacaatcttggccactgggaaacaggactaccctgaaagctgaaaggccctcaggacatcccaactggatgaccttcagctccttgagctgaagggggccctacgctccacttggctcctggattaaataacactattgaagggacagagccaagggctgccttggatgtgcccagtaggactgtaagttttcttttggacatgagggctgcctgctcaatgcttacctcttttcccaggcaattatcctcctgggaggatatgaagtgcccgtaacctggaggtttactcctcctctgtgctgtctctgggggaaaaccgtcttttctcattcatttttagtgatgccagaataccctacataccttttgggtagagatattttgctcagactaggggctcagttaacctttcctccagggccaacaccccctttttcaaatgcaatcttatgcctcaaggaaaccatacacaaggatgaactgttcacagaccttcccatttatccagaggtctgggcctcaggaataacaggaaaggccataatggcaatgcctatagtaattcagcccaagaatccttctagctatccttgtagaaggcagtttcctcttcagctggaggccaaagagggatttcagcttctgactgaaaaatttcaaaaacatggattattaataccctataacaccccatcttacctgttaaaaagagcaatgaaaaatacaggctagtccaggacctgagaatcataaatgaggcagtagtcccaatacacccaatgatccccaactcatatgtaattcttccccaacctccagatgctcagtggtttccagtcttagaccttaaagactctttcttttgtatctccccctcgacccatcctcccaatttctatttgcatttgagtgggagaatgaaaaggaaggagtcaacagctcacctgcacagtgcttcaacagggtttcagagacagtccccattggtctgggcaagccctggctagagatttgcaggacctaagtcttgagaggagagagtgtctcctacaatacatggatgacctgttaatctgctccccaacaagagaactgggaatccaacatctagtccaaacaccaaacttccttgcagacagagaatacaacgtgtc

SEQ ID NO: 492 - DNA, 7903 bp, Homo sapiens
cccttttgggtcccctcccattgtatgggagctctgttttcactctattaaatcttgcaactgcacactcttctggtctgtgcttttcacagcttgagctgagctttcgctcgctgtccaccactgttgtttgccgccgtcgcagacccgccgctgacttccatccctctggatctggcaaggtgtccactgcactcctgatcgagtgaggcgtccattgctgctctgatcagactaaagtctcaccaatgttcgggcacggctaagcacctgggttcatcctaattgagctgaacactagtcactgggttccatggttctcttccatgacccacagcttctaatagagctacaacagtcaccacatggcccaaggttccattccttggaatgtgtgaggccaagaaccccaggtgagagaacaaaaggcttgccaccaccttgggagcagcccgccaccatcttgggagctctaagaacaaagacccgccggtaacatttggtagaccgtactgggattctccaaagaggtgagtaatatgagaccactttcacttgctattctgtcctatccttccttagaattgaaggaaaatactaggcacctgttggccagttaaaaacaatgagcatggctgcctgacttaagactcaggtgtgaggcttcctgggaaaacgctttctaacaacccccaaccctctgggttgggagcgttggtctgcctggaaccagcttccgctttcacaatttttctgggggaagccgagggccaactagaggcagagagctgtcgtcctgaactcccggcataagccagctgagatcatggcacagccagaagtctctcttcaacagttgcccatgcgtgcgccccatctttccttctgacctatacctcctaggtcccgaccacaactttcttgaaagtatagccccaaaattctccttacctttgaatctacttcctctgatccctgcctcctaggtactaatgcttcagactttcacttcctctcccaagtattagagcaagttgtatctccaaagggatctaaggaagctctacactgtgtccttagggccctaggctatgaacccagggtgtcttgtccctcgtgtccctcccaatttaggcatacagctctcaacatgggcagttatgtgacacctgttccccaccatccttgccagggccttagaactgatgacccagtactttaacaactggaactgggtctacaacaacataacagatcaggatgaaagtgaattgagtaagtcaaggcagagagagagaggggaaagagaggcagggggtggggaaagagaggcagaaagagagaaaaagagagatagaagtagtaaagaaaaaaagtgtgccctattcctttaaaagccagggtaaatttaaaacctataattgataattgaaggtcttctccatgaccctataacactccaatactaccttgttgtcagtgtaaacaagggtgtagcctgaaaacagtgaaaccactgacaacccgtagccttcctatcaaaaatccttatctcagccatggatggcccaaatgcattcaatctgtagcagcaactgctttgctaacagaataaaatagaaaaataacctttagaggaaacctcattgtgagcacacctcaccagttcagaactattctaagtcaaaaaagcaaaaaggtagcttactaactcaaaaatcttaaagtatggggctattctgttagaaaaagttgatttaacattaatcactgaaaattcccttaacccagcagatttcctaacaggggatttaaatcttaattaccatacaaaggtccgaccagacctaggaggaactcccttcaggacaggaggacagatggcacctcccgggtgattgagagaaaaaccacaatgggtattcagtaattgatagggagactcttgtggaagcagagttaggagaattgcctaataattggtctgctcaaatgtctgagctgtttgcacttagccaagcctcaaagtacttacggaatcaaaaaaactctatctcaatcctgactcaaaaggttacctacaccctctctgaaatgaatttgcataaggactgttgtttatgggaatgcatcttgatggagcagctgggttgctatgaaatactcaggaacccagcccagctctaggactcacccctgagcacaaaggcaatgttgggcacgctggaaaaggaccactagaatccagcagcctggacccctttctttgtggtcaagaaaggtgggaaaaggggtgcaggactgctacatcggtgagcgtaacgaatccaataagcagaggtccatgggttgttatacgtcctggaaaggaataagcattaggaccacagaggacacctatgactaatgctcatcagaaaatgactaggggtgctggcatccctatgttctattttcagatgggaaacgttctccacaaggcaaaaacacccctaagatgtattctggagaattcagcccagtcagagtgcatgtacctttttccctctcagacttgaagcaaattaaaatagacctaggtaaattctcagatgaccctgatggctatattgatgttttacaagggttaggacaatactttgatctgacatggagagatgtaatgttactgctagatcagacactaaccccaaatgagagaagtgccaccgtaactgcagcccgagagtttggcgatctctgatatctcagttacagttaagtcaatgataggatgacaacagagaaaagaacaattccccactggccagcaagcacttcccagtgtagaccctcattaggatgcagaatcagaacatggagattggtgctgcagacatttactaacttgtgtgctagaaggactaagggaaactaggagaaagcctataaattattcaatgatgtccactataacacagggaaaggaagaaaatcctactgcctttctggagagactaaggaaggcattgaggaagcaaacctccctgtcacccgactctattgaaggccaactaatcttaaaggataagtttatcactcagtcagctgcagacattagaaaaaaacttcaaaagtccgccttaggcctggagcaaagcttagaaatgctactgaacttggcaacctcggttttttataatagagatcaggaggagcaggtggaatgggacaaacgggataagaaaaaggccaccgctttagtcatggccctcaggcaagcagactttggaggctctggaacagggaaaggctgggcaaatcaaatgcctaatagggcttgcttccagtgcagtctacaaggacactgtaaaaaagattgtccgaatagaaataagccaccccctcgtccatgccccttatgtcaagggagtcactggaaggcccactgccccaggggatgaaggtcctctgagtcagaagccactaaccacatgagccggtagcaggactgagggtgcccggggcaagcaccagcccataccatcaccgtcacagagcctcgggtatgcttgaccattgagggccagaaggttaactgtctcctggacactggtgcggccttctcagtcttactctcctgtcccggacaactgtcctccagatctgtcactatctgaggggtcctatgacagccagtcactagatacttctcccagccaataagttgtaactggggaactttactcttttcacatgcctttctaattatgcctgaaagccccactcctttgttagagaggacattctagcaaaagcaggggccattagacacctgaacataggagaaggaacacacgtttgttgtcccctacttgaggaaggaattaatcctgaagtctgggcaacagaaggaaaatatggacgagcaaagaatgctcatcccattcaagttaaactaaaggattctgcctcctttccctaccaaaggcagtacccacttagacccgaggcccagcaaggactccaaaagattgttaaggacctaaaagcccaaggcctagtaaaaccatgcagtagcccctgcaatactccaattttaggagtacagaaacccaatggacaatggaggttagtgcaagatctcaggattatcaatgaggccattgtccctctatacccagctgtacctaacccttatactccactttcccaaatactagaggaagcagagtggtttacagtcctggaccttagggatgcttttttctgcatccctgtacatcctgactctcaattcttatttgcctttgaagatcctttgaacccaatgtctcaactcacctggactgttttaccccaagggttcagggatagcccctatctgtttggccaggcattagcccaagacttgagccagttctcatacttggacactcatgtcctttggtacatggatgatttacttctagctgcccgttcagaaaccttgtgccatcaagccacccaagcgcttttaaacttcctcgccacttgtggctacaaggtttccaaaccaaaggctcagctctgcttacagcaggttaaacacttacggctaaaattatccaaaggcaccagggccctcagtgaggaacgtatccagcctatatcggcttatcctcatcccaaaaccctgaagcaattaagaatgttccttggcataacaggcttctgccaaatatggattaacaggtatggcaaaatagccaggccattatacacactaattaaggaaactcagaaagccaatacccatttagtaagatagacacctgaagcagaagtggcttttcaggtcctaaagtagggcctaacccaagccccagtgttaagcttaccaacgaggcaagacttttctttatatgtcacagaaaaaacatgaacagctctaagagtccttacacaggtccgaaggaccagcttgcaacccgtggcatacctgagtaaggaaactgggaccagcttgcaacccgtggcatacctgagtaaggaaattgatgtagtggcaaagcgttggcctcactgtttacgggtagtggcagcaatagcagtcttagtatctaaagcagttaaaatgatacaaggaagagctcttactgtgtggacatctcatgatgtgaacagcatactcactgctaaaggggacttgtggctgtcagacaaccgtttgcttaaatatcgggctctattacttgaaggaccagtgctgtgactgcacacttgcgcaactcttaatccagccacatttcttccagacaatgaagaaaaaatagaacataactggcaacaagtaattgctcaaacctatgccgctcaaggggaccttttagaggttcccttgactgatcccgacctcaacttgtatactgatggaagctcctttgtagaaaaaggacttcgaaaggcggcttacgcagtgttcagtgataatggaatacttgaaagtaatcccctcactccaggaactagcactcagctggcagaactaatagccgtcactcaggcactagaattagaaggaaaaagggtaaatatatacagactaagtatgcttacctagtcctccatgcccatgcagcaatatggagagaaagggaattcctaacttccgagggaacacgtatcaaacatcaggaaaccattaggacattattattggctgtacagaaacctaaagagatggcagtcttacactgctggggtcatcagaaaggaaaggaaaggaaagggaaatatagggaatcgccaagcagatattgaagccaaaagagccacaaggcaggactctccattagaaatgcttacagaaggacccctagtatggggtaatcccctctgggaaaccaagctccagtactcagcagaagaaatggaatggggaaactcacgaggacatagtttcctctcctcaggatggccagccaccaaagaaaaaatacttttgcctgcagctaaccaatggaaattacttaaaacccttcaccagacctttcacttaggcattgacagcacccatcagatggccaaatcattatttactggaccaggccttttcaaaactgtcaagcagatagtcagggcctgtgaagtgtgccaaagaaataatcccctgccttattgccaagctccttcaggagaacaaagaacaggccattacccaggagaagactagcaactagattttacccacatgcccaaatctcagagatttcagtatctactaatctgggtactttcactggttgggtggaggccttcccttgtaggacagaaaaggcccaagaggtaataaaagtactaattcatgaaataattcccagattcggacttccctgaggtttacagagtgacaatggccccaatttcaaggctgcagtaacgcagggagtatcccaggcgttaggtatacaatatcacttacactgtgcctggaggccacgatcctcaggaaaagttgagaaaatgaatgaaacactcaaacgacatctaaaaaagctaacccaagaaacccaccttgcatggcctgctctgttgcctatagccttactaagaatccgaaactgtccccaaaaagcaggacttagtccatatgagatgctgtatggacagcccttcctaaccaatgaccttgtgcttgactgagagacggccaacttagttgcagacatcacctccttagccaaatatcaacgagttcttaaaacattacagggaacctgtccctgagaggagggaaaggaattattccaccctggtgacatggtattagtcaagtcccttcccctttaattccccatccctacacacatcctgggaaggaccctacccagtcattttatctaccctaaccgcagttaagtggctggagtggagtcttggataagtcacactcgagccaaaccctggatactgccaaaggaacccgaaaatccagcagacaatgctagctattcctgtgaacctctagaggatctgcgcctgctcttcaggcgacaaccgtgaggaaagtaactagaatcgtagatcctcttggccctcccttgtcatatttttctttttactgttctcttaccccctttcactctcactgcaccccctgtatgctgctgtactaccagtagctccccttaccgagagcttctatggagaatgtggcttcctagaaatattgatgccctattgtatcggagtttttctaaaggaaaccccacttgcaccgcccacactcatatgcccctgcacttcaggccgtacatttcaatccttgtatctttaacctccttgttacgtttgtctcttccagaatcgaagctgtaaaactacaaatggttcttcaaatggagccccagatgcagtccatgactaagatctaccgcggacccctggactggcctgctagcccatgctccaatgttgatgacattgaaggcacccctcccaaggaaatctcaactgcacgacccctactatgccccaattcagcatgaagcagttaagagcggttgtcagccaacctccccaacagcacttgggttttcctgttgagaggtgggactgagagacaggactagctggatttcctaggctgactaagaattcctaggcctagctgggaaaggtgaccacacctacctttaaacacagggcttgtaactcagctcacactcagccaatcaggtataaagagggctcactaaaatacaaattaggctaaaaagaggaggtaaagaaatagtcaaatcatatatcgccagagagcatggggcagggataatgatcgggatataaacacaggcatttgagcacggagtggcaaccccctttgggtcccctcccattgtataggagctctgttttcactctattaaatcttgcaactgca

SEQ ID NO: 493 - DNA, 661 bp, Homo sapiens
agttaggcattcatgagcaggacaggagaggaccccttcctctaggaatgtcaggtgatgatggtcaggtggttgttaaactctcgttctaaaatcataattggtcacagctggcaccaaagaatgacagtctcccaatagatagacaacacctagaactggtgatcagcagcttcctgataaggtctcaggagatgagcaagtgggctcaagcatgcacactaagaggcaaaatggcagggacccttcctccgggaacgcttcactggtaagggaaaaacacctcaggtgagcatgcacacaacttcagtaaacacactgtgcatgcggcccctcccaagtgctggcaggctaccacacatgcagacagcccacctcaagaaaaaatcaaggagaaatgaaaaccccagaaccatgccaatgtataaaatccaaagtcaagggccgaacagggcacttagattgctccagttgcctgcttggccctcttccacatgtactttgctgcctttcattcttgctctaaaactttttaagaaactttcactcctgctctaaaacttgccttggtctctcactctactttatgctcctcagctgaattctttcccccaaggaggcaagagttgagtttgctgaagatgggtcagacttgccactg

SEQ ID NO: 494 - DNA, 6581 bp, Homo sapiens
gtcagatctctgagcccaagctaagtcatcatatcacctgtgacctgcaagtatacatccagatggcctgaagcaactgaagatccacaaaagaagtgaaaatagccttaactgatgacattccaccattgtgatttgttgctgccccaccctaactgatatgatatattctccctctcccttgaggaggtactttgtaatattctcccccgcccttaagaaggtactttgtacacctatcccaaacctataagaactaatgataatcccacaaccctcagctgactcctttttcagactcagcctgcacccaggtgaaataaacagccttgttgctcacacaaagcctgttggtggactctcttcacacggacatgcatgacatgtggtgctgaaacgcaggacaggaggactccttcaggagaccagttacctgtccttgccctcactccctaagaagatccacctacgacctcgggtcctcagaccaaccagcccaagaaatatctcatcaattttaaattggataagtggtcttttcactcttctccagtctctcttgctacccttcaatcttcctctctcactactcttcaatctcccttgctcactactcttcaatctctctatacttccaattctaattctttttcctctctagtagagacaaggagacacattttacctgtgaacccaaaactgtggtgccagtcacggactcaggaagaaagtgttcccttggtgtttaatcactgcggggatgcctgtctgattattcacccacatttcattggtgtctgatgaccacagggatgcctgccttggtcattcactcacattcccttggtggcaagtcaattgcagggacacctgctttggctgctcacccacattgcagcccagggctgctcacccccttctccatgtttcttcctttatctttaaacttacctccttcgctatgggcaatcttctaccctccattcccccttcttctcccttagcctgtgttctcaataacttaaaacttcttcaactcacacctgacctaaaacttaagtgccttattttcttctgcaataccgtgtggcaccaatacaaactcgacagtagttccaagtggccagagaatggcactttcaatttgtctatcctataagatctagataatttttgtcaaaaaatgggcaaatggtctgatgtgcctgatgtccaagaattcttttacacattggtccctccctagtctctgctcctaatgtgactaatcccaaatctttcttctttctctcctgtctgttccttcagtgtccatcccaagctctgaatcctttgaatcctccttttctatggactcatctgacctctccccaactccccaggctaagtcaggttccaactcttcctcagcctccactcccccaccttataacccttctatttcctcccctcctcacacctggtccagcttacacttttgttccacaactagccctccaatatctggccaataatttcctcttaaagaggtggctggagctaaaggcatagtcaaggttaatgctccttttttctttatcgaacctctcccaaatcagttagcatttaagatctttttcatcaaatataaaaacccagcccagttcatggcctgtttggcaacaacccttagctgctttactgtcctaaacccagaggggccagaaggacatcttattctcaatatgcattttattacccaattggctcctgacattagagaagctctaaaatttagattctggccctcaaccccacaacagggcttaattgacctcactttcaaggtgtacaataatagagaatagttgcaattacttgcctcctctgtgagagaaaccccagccacatctccagcacacaagaactccaatacacctaaaccgcaggggccaggcattcctccaggactccctcccccaggatcttacttcaagtgttgggaatctggccactgggccaaggaatgcccacagcccaggattcctcctaagctgtctcccaattgtgcaggaccccactggaaatcagactgtccagctcacccggcagtcactcccagagcccctggaactctggcctaaggctctctgactgactcctttccagatcttctcagcttaatggctgaagactgatgctgcctgatcacctcagaagcctacaggacaatcgcagatgttttgagtaactcttgcagtggagggtaagtccgtccccttcttaatcaatatggaagctacacacttcatattaccttcttttcaagggcatgtttcccttgcttccataactgttgtgggtattgatggccaggcttctaaacctcttaaaactgtccaactctggtgccaacttggaatacattctttcctgcattcctttttagttatccccacctgcctagctcccatattagcttgatacattttaactaaattatctgtttccctgactattcctggactacagccacacctcattgccaccttttcctccagtttaaagctgccttcacatcctctccttgtatctccctacctttatccacaagcataggacacatctattccctccttggcaatggatgatgcaccccttaccatctcattaaaacctaatcagccttaccttgctcaatgccaatatcccatcccacagcatgctttcaaaggattaaagcctgttatcactcacctgtcacagaatggccttttaaagcctgcaaactctccttacaattcccccattttacctgtccaaacaccagactagtcttacaggttagttcaggagctgcaccttatcaacaaaattgtcttgcctatccacctcgtagtgccaaacccatatactctcctatcctcaatgagacctccctccacaacccattattctattctagatagacctagctgacccaataaatcctaaatactttccccactcccctttccattccttaacaaacagccctaaaagctgttcccacactagctctccttagctcatcccaacctttttcattacacccatccaaagtacagggatatgtggttggaattctttcacaagagccgggactgcaccctgtagcttttctgtccaaacaacttgaccttactgttttagcctagccctcatgtctgtgtgtggtggatgccactgctttaattcttttagtggctatcaaaaattacaaactatgctcaactcaatctctacagttctcataacttccaaaatctattttcttcttcacccctgacacatatactttctgccctccagctccttcagctatactcagtctttgttgagtctcccacaattaccattgttcctggcccaggcttcaatccagccttccacattactccggatatcacacctgacccccatgactgtatctccctgatccacctgacattcactccatttccctgtatttccttctttcctgttcctcaccctgatcacacttggtttattgatggctgttccaccaggcctaattgccactcaccagcaaaggcaggctacattatagtatcttccacatctatcattgagactaccactctgccctgctccatacctctcagcaagccaaattcattgtcttaactcagtccctcactcttgcaaggtgactatgtgtcaatatttatactgcctctaaatatgccttcaatatcctgcaccaccatgctgtatatgggctgaaagaggtttcttcactatgctaggtcctccatcattaatacctccttaataaaaactcttgttaaagccactttacttccaaaggaagctgaagtcattcactacaagggccatcaaaaggcatcagatcccactgctcaagaaaatgcttatgctgataaggtagctaaacaagcagctagcattccaacttctgttcatcatggccactttttctccttctcattgcttactcccacctactctccccctaaatcttccatatatcaatctcttcccacacaaggcaaatggttcttgaaccaaggaaaatatctccagcctcacaggcccattctattctgtcatcatttcataacctcttacatgtaggttacaagccactagcctgactcttagaacctctcatttcctttccatcatggaaatctatcctcaaggaaatcacttctcagtgttccatctgctattctaccacacctcagggattgttcaggccccctcttttccctacccatcaagtggggggatttgcccctgcccaggactggcaaattaactttactcacatgccctgagtcaggaaactaaaatacctcttggtctgggtagacactttcactggatgggtagaggcctttcccacagggtctgagaaggccaccacagtcatttctttccttctgtcagacataattcctcagttttcccttcccacctctgtatagtctgataacagaccagcctttatcagtcacatcactcaggcagtctcccaggctcctggcattcaataataacttcatgctccttatcaccctcaatcctcaggaaaggaagaaagaactaatgattttttaaagccacacctcaccaagcttagcctccaacttagaaaggactggacagtacttttaccaattgcccttctcagaattcgggcctgtcctcgggatgctacagggtacagccatttgagttcctgtattaggccttattaggccccagtctcattccagacaccggccctctaggtgattatcttccagtcctccagcaagctagacaggatattcactgagctgctaatcttcttttgcctaccccagattcccagctatatgaaaacactttaacttgacagtcagttctcgttaaaaatcggacccctcagactctacaacctcagtggactggagcccatttagtcatctatagtatccaaatggctgttcatctgcaggaccaccacccaccattcggttcatcattccagagtaaacctgtgcccatcagacagtctgatttctcctcttccttctgaaagtggcaagtactcacccctacttcccttaaactcacttgcattcctcaatgataatagaaacccttataagcctaatacatcctttcatttttattaggtatcttcttccttaccctactctttacaacagggctttagccagtcacccccactacttggactacacctcaaaaacttgtcgtccttactatcttctgtctagttatactcctattcaccattctcaactactcataagtgcccttgcccttgtttacactgccagtttacacttttcctccaaaccatcgtagtggacatctcctggtactaacccgaatccactactcttgactccctcttacagtggatagatgatttttgctgacagggcgctctccaatactttcaccctgataacgtcctattctttacttttatactcactcttatttttgttctgattcttatattcttatgccaccctctacctctccccagctatctccatcacactaacaatctcactcactctatcctagccttttctaatctttccttaacaaacatttgctggctttgcatttctctttcctcaaatcactgagtccttgacttactcactgctaaaaaaaaaaaaaaaagttgggggggggactctgtatgtttttaaatgaagagtgttgtttttacctaaatcaatctggcctggtatatgacaacataaaaaactaaaggatagagcccaaaaactcaccaaccaaataagtaattatgctgaacccccttgtacactctctaattcaatgtcctgggtctcccagttcttagtcttttaatacttgtttttctccttctcctattcggaccttgtttccatttagtttctcaattcatgcaaaactgtatcctggccatcaccaatcattctatatgacaaatggtccttttaatcaccccacaatatcaccccttaccacaaatcttccttcagcttaagctctcccactgtaggttcccatgctgccactaatcccactcaaagtagccctgagtaacatcgcatattatctgtccataccaccccccaaaatttttgcctcctcaacacttcaccactattttgttttgtttttcttattaatataagaagacaggaatgtcaggcctctgagcctgagctaagccatcatatcccctgtgacctgcaagtgtacatccagatggcctgaagcaactgaagatccacaaaataagtgaaaatagctttaacagatgacattccaccattgtgatttgttcctgacccaccctaactgatacaatatattccccccccaccattaagaaggtactttgtacacctatcccaaacctataagaactaatgaaaatcccatcaccctttgctgactccttcttcgactcagcccacctgcaaacaggtgaaataaacagccttattgctcacacaaagcctgttggtgaactgttttcacagggacacatg

SEQ ID NO: 495 - DNA, 677 bp, Homo sapiens
ttatagtaggtagtcaggcagacatgatcagggcaggagaggtccctctcactgccaccaggaatgtcaggcgaccctcaggtcaggcagttgttatactgtttctctaaaataataactggtgtcagccagtgccagggaaaggcagtctcctaatagatagaaaaacctgaaactggtgataagcagcttcctgataagatctcaggagttgggtgagtgggctcaagcacgcgcatgaagaggcaaaatggcggagttcaggtatggtatgacctaggaatactggactggtaagggaggaacaccttaagtgagcatgcatagaactccagtaaacacattgtgcatgctccctccgaaatgctggcaggccacccggcatgcggacagcccaccccaagggaagaatcaggggagaagggacgcaatctcccggaaagcatgccaacgtgtaagaccccaagtcaaaggtcaaactgcacacttgatctcccaagtcacagagagagtaacccctcttccaaggttactttacttcctttcattcctgctcaaagctttttaataaactttcactcctgctgtgtaacatttgcctcagtctctccttctgcccctcaaattctttcttctgaggaggcaagaattgaggttgctgcagacccagacagatt

SEQ ID NO: 496 - DNA, 907 bp, Homo sapiens
gtagctagtcagatatgagcagagcaggagaggacttcccccacccaaacacacacaccaggaacgtcgggtgaccatcaagtgatggtcaggcaattgttaactgtctctctaaaataataatttgtcacagccagcaccagggaaaggcagtctcccaatagataaaaaatcctgaaattggtgactggcagcttctcgataaaatctcaagagttgagtaagtgggctcaagcctgcacactatggaaatattttgcagaccctgtgcttgatggatcagctggcaccactcagactgataaatggtctcatctggtcttgtggccccccaacccaggaactgactcagtggaagaggacagctttgactccctatgatttcagctctgaaccaaccaattagcactcctgacttactggccccctacctaccaaattatttgcacactaagaggcaaaatggtggatgaccttcctctaggaacactggcctagtaaggggaaaatgcctcaagtgagcatgggtaaaactccagtaagcacactgcacatgttcccctcccaaaccctagcaggccactgcacatgcggacagcgcaccccaagggaagaatcaggggaaaagagacgcaagaccccagaagtatgccaatgtataaaaccccaagtccaaattcaaacagtacagttgatctctcaagttgcctacttggccctcttctaagtgggctttactttcattcattcctgctctaaaactttttaataaactatcactgctgctcaaaacctgcctcagtctctccttatgccttatgcccctcagttgaattttttcttctaagaaatcaaggattgaggttgctacagaaccatatggatttgcgatcagtgacatgctttg

SEQ ID NO: 497 - DNA, 97 bp, Homo sapiens
ttttgggaaagtaaaaccaagggagctaaccaaagtaaaaccccatacacccaaatctgagcaagcataactatagccaccagttatctgggtgtgt

SEQ ID NO: 498 - DNA, 998 bp, Homo sapiens
ctttcacgtagacccccatagagttgtaagcccttaaaagtgtgtccagacttggttccctctggtggattcttggtctcactgacttcgagaatgaagctgcggaccttcacagcgagtgttacaacttttaaaggtggtgtggacccaaagagtcagcagcagcaagatttactgtgaaaagcgaaagaacaaagcttccacagagtggaaagggacctgagcaggttgccgctgctggctggggggtggccagcttttattcccttatttgtccccacccatgtcctgctgattggtccattttacagagtgctgattggtccattttacagagtgctgactggtgcatttttacagagttctgattggtgcatttaatcccttagttagacacagagtgatgattggtgtgtttttgcggagtgttgattggtgcacttacaatcctttagctagatgccaagtgctgattggtgcatttttacagagtgctgattggtgcgtttacaatcctttagctagacacagaatgctgattggtgcgtttacaatcctttagctagacacagtgcgctgattggtgcgcttttatagagtgctgattggtgcgtttacaatcctttagctagacacagagtgctgattggtgcatttttacagagtgctgattggtgcgtctacagtcctttagctagacacagagcgctgactggtgcatttttacacagtgctgattggtgtgtttacaatcctttagctagacacagagtgctgactggtgcgtttgcaatcctctagctagacagaaaagttctgcaagtccccactcaacccaggaagtccagctcgcttcacctctcaaaaaggccaggaattttttcttcagggagcttggttcttgagatgcaagtctgccaaggttcccagctaaataaagcctcttccctctttcagccggtgtctgaggagttttgcctgcagcccatcctgctaca

SEQ ID NO: 499 - DNA, 4606 bp, Homo sapiens
gtcaggcctctgagcccaagctaagccattatatcctctgtgacctgcatgtattcatccagacggcctgaagaatcacaaaagaagtgaaaatggcttgttcctgccttaactaatgactttaccttgtgaaattccttctcctggctcagaagctcccctactgagcaactcgtgacccctgtccctgcccaccagagaactacccactttgactgtaatttttcattacctacccaaatcctataaaacaaccccaccccatctcccttcactgactctcttttcagactcagcccacctgcacccaggtgaaataaacagctttgttgctcacataaagtctgtttagtggtctcttcacacggatgtgcatgacatctggtgccatgacccagactgggtaacattccttgggagatcaatcccctgtcctcctgctcttttctccatgagaaagatcaacatacaacctctggtcctcagatcaaccagcccaaggaatatctcaccaattttaaatcgggttaacggcctctttttactctcttctccaacctctctcactatccgtcaacctctttccatttcaatcttggggccacacttcagtctctcccttcccttaatttcagttcctttccttttctggtagagacaaaggagatgtgttttttctgtggacccaaaactctggccctggtcacagacttaggaagacagtcttccctaggtatttaatcatgcggggacacctgcctgattattcacccacatttcattgatgtctgatcaccacagggatgcctgccttggtcatttaaccacattccttttgtggcaagtcagttgtggggatgcctgctttggatgtacacccacaggcagcccagggctgttcactcaccccttctctccacatctctacccatcccttttccacttttctagggggcaagcacctcctgccccttctctccctgtctccaccccttctccactttcctggggggcaggtatcccccacaccttctctctatgtctctatactcttttttctctggacttgcctccttcactatgggcaaacttccaccctccattcctccttcttctcctttagactgtattctcaacaatttaaaacctcttcaactcacacctaacctaaaacctaaatgccttattttcttctgcaatgcctcttgacctcaatacaaacacaatagtggttccaaatagccagaaaatggcactcttgatttttccatcctataagatctaatgagttcttgtcataaaatgggcaaatggtctgaggtgcctgatgtccaggcattctttcacacattggtccctccctagtctctgttcccaatgcaactagtcccaaatcttgcttctttccctcctgcctgtcccctcagtcccaatcccaagtgtcactgagtctttccaatcttcctttctatggacccatctgacctctcccctcctccccaggctgctcctcaccaggccaagccaggtcccaattcttcctcagcctctgctcatgcaccctataatccttttatcacctcccctcctcaaaccctgtctggcttacagttttgttccagtctggctcacagtttctttccacgactagctctcccctacatgactagcactttcctcttaaaaaggtgactggagctaaaggcacagtcaaggttaatgctcctttttctttatctgacttctccaaaatcagttagcatttaggctctttttcatcaaatagaaaaacccagcccagttcatgcctcatttggcagcaacccagagacactttgcagccctagaccctaaaaggtcaaaagactgtcttattcttagtatacattttattactcagtcagctcctgacattaaataaaactccaaaaattaaattccagccctcaaaccccacaacaggacttaattagcctcatcttcaaggtttacaataatagtgtagaggcagccaagtaacaacatatttctgagttgcaattccttgtttccactgtgagacaaaccccagccacatcttcagcacacaagaacttccaaatgcctgaactgcagtggccaagtgttcctccaggaactcctaccccaggatcttgcttcaagtgccagaaatctgtccacagagccaaggaatacctgcagcctgggattcctcctaagctgtgtcacatctgtatgggaggccatcacagaggctttgggtaacactcatagtggagggtaagtctgtacccttcttaatcagtacagagactacccacttcacattaccttcttttcaagggcacgtttccctggtctccataactgttgtgagtattgatggacaggcttctaaacctcttaaaactccccaaatctggtgcaaacttggacaatattcttttatgcactccttcttagttatccccacctgcccagctcccttattaggtcaaacattttaactaaattattggcttccctgactattcctaggctacagccacacctcattgccacattttcccccaattcaaatcctccttcacatcctctccttgtatctacccaccttaatccacaagtataggacacctctacgtccttcttgacaatagatgatgcacccccttaccatcccatgaaaacctaatcaggcttaccccactcaatgccaatatcccatcccacagcatgctttaaaaggattaaagcctgttatcactatcctgttagagcatggccttttaaagcctataaactctccttacaattcccccattttacccgtcctaaaaccagacaagccttacaggttacttcaggatctgttccttatcgaccaaattgttttgcctacccaccccatggtgccaaacccatatactctcctatcctcaatacctccctccacaacccattattctgttctggatctcaaacatgccttcttcactatttgtttgcacccttaaccccagcttctcttcactttcacttggactgacactgacacctatcaggctcagcaaattacctgggctgtactgccacaaggcttcacagacagtccccattacttcagtcaagccagagttcctacctgtgaacacatcctgtatccttttcatctaaacaacttaaccttactcttttagcctagccctcatgtctgtgtgctgcagctgccactgccttaatacttatagaggccctcaaaatcacaaactatgctcaactcactctctactctctacagttctaataacttccaaaatctatttcctgcctcacacctggtgcatctactttctgttacctacccacactacctctcagcaagctgaactcattgccttaacttgagaccttgctcttgcaaaaggactatgcatcaatatttatactgactctaaatatgccttccatatcctgcaccacaaagctgttatatgggaaaaaaaaattcctcactatgcaagtgtcctccatcattaatgcctctttaataaaaacgcttctcaaagctgctttacttccgaaggaagctggagtcattcactgcaagggccatcaaaaggcatcacatcccattgctcagaacaatgcttatgctgataaggtagctaaaagagcagccatccaaaggcatcaggtcccatcactcagcacaatgtttatgctgataaggtagctaaaaagcagctagtattccaacttctatccctaaagcagtttttttccttctcattgttcactcccacctactccccaatgaaacttccaactaccaatctcttcctacacaaggcaaatggttcttggagcaagaatgattccagcctcacaggcccattctattctgtcatcatttcataacctcttccatgtaggatacaagccactagcctgccttttagaacctctcgtttcctttccattgtggaaatctatccttaaggaaataacttctcagtgttccatctgctattctactcctcctcctcagggattgttcaggccccccacattccacttccctacacatcaagctcagggatgtgcccctgcccaggactggcaaattgactttactcacatgccctgagtcagaaaactaaattatctcttgatctgggtagacactttcattggatgggtacaggcatttcccacagatctgaaaaggccacctcggtcatttcttcccttctgtcagacagaattccttggtttggccttccaacctctacacagtctgataacggactggcctatattagccaaatcacccaagcagtttttcaggctcttggtattcactgaaacctttatatcccttactgtcctcattcttcaggaaaggtagaatggactgatggtcttttaaaaacacacctcaccaagctcagccaacaacttaaaaaggactggacaatactttaccgcttgcccttctcagaattccggcctgtcctcggaatgctacagagtatagcccatctgagctcctatatagatgctcctttttattaggccccagtctcattccagacaccagacc

SEQ ID NO: 500 - DNA, 971 bp, Homo sapiens
ggaggggatgtggggaaaagcaagagagatcagattgtcactgtgtctgtgtagaaagaaatagacatgggagactccattttgttatgtactaagaaaaattcttctgccttgagattctgtgaccttacccccaaccccgtgctctctgaaacatgtgctgtgtcaaactcagggttaaatggattaagggcagtgcaagatgtgctttgttaaacagatgcttgaaggcagcatgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgactgtccccccgcccgacaccccgacacccgtaaagggtctgtgctgaggaggattagtataagaggaaggcatgcctcttgcagttgagacaagaggaaggcatctgtctcctgcccgtccctgggcaatggaatgtctcggtataaaacccgattgtatgttccatctactgagatagggaaaaaccaccttagggctggaggtgggacatgcgggcagcaatactgctttgtaaagcattgagatgtttatgtgtatgcatatctaaaagcacagcacttaatcctttaccttgtctatgatgcaaagacctttgttcacgtgtttgtcggctgaccctctccccacaattgtcttgtgaccctgacacatccccctcttggagaaacacccacgaatgatgaataaatactaagggaactcagaggctggggggatcctccatatgctgaacgctggttccccgggtccccttatttctttctctatactttgtgtctttttctttcctaagtctcttgttccaccttatgagaaacacccacaggtgtggaggggcaacccacccctaca

SEQ ID NO: 501 - DNA, 1902 bp, Homo sapiens
tctaaacttttagaggccctcaaaatcacaaactatgctcaactcactctctaaagttcacaacttccaaaatctatttgcttcctcatacctgatgcatatactttctgctccccggctccttcagctgtactcactctttgttgagtctcccacaattaccattttccctggcccagacttcaatctggcctcccacattattcctgataccacacctgacccccataactgtatctctctgacccacctgacattcaccccatttccccaaatttccttctttcctgttcctcaccctgatcacgcttgatttattgatggcggttccaccaggcctaatcgccacacaccagcaaaggcaggttatgctatagtacaagccactagcccgcctctcagaacctctcatttcctttccattgtggaaatctatcctcaaggaaataacttctcagtgttccatctgctattctactactcctcagggattattcaggccccatcccttccctacacatcaagctcgaggatttgcccccacccagaactggcaaattagctttactcaacatgcctgagtcaggaaactaaaatacctcttagtctaaatagacacttttactgaataagtaaaggcctttcctacagggtctgagaagtccaccgcagtcatttcttcccttctgtcagccataattcttcagtttagccttcccacctcaatacggtctgataacagtgagcctttattagtcaaatcagccaagcagtttttcaggctcttagtaatggactaaaggtcttttaaaaacacacctcaccaagctcagccactaacttaaaaaggactggacaatacatttaccacttttgcttctcagaattcaggcctgtcctcagaatgctacaaggtacagcccatttgagctcctgtatagatactcctttttgttaggccccagtctcatttgacaccagaccaacttagactgtgccccaaaaaaacttgtcatccctactatcttttgtctagtcatactcctattcaccgttctcaactactcatacatgccctgctcttgtttacactgccagtttacactgtttctccaagccatcacagctgatatctaccttttatacctgtttttctccttctcttattccatttagtttttcaattcatacaaaaccatatccaggccatcgccaatcattctatacgacaaatgtttcttctaactaccccacaatatcaccccttaccacaagacctcccttcagcttaatctctcccactctaggttcccacaccgcccctaatcccgctcgaagcagccctgagaaacattgcccattctctcttcataccaccccccaaagattttcgcagccccaacacttcaacactattttatttttcttattaatataagaaagcaggaatgtcaggcctctgagcccaagacaagccaagccatcgcatcccctgtgacctgcacgtatacacccagatggcctgaagtaactgaagaatcacaaaagaagtgaatatgccctgccccaccttaactgatgacattccaccacaaaagaagtgtaaatggctggtccttgccttaactgatgacattaccttgtgaaagtccttttcctagctcaccctggctcaaaaacacccccactgagcaccttgctaccccaactcctgcccaccagagaacaaaccccctttgactgtaattttcctttacctacccaaatcctataaaacggccccacccttatctcccttcgctgactcttttctgactcagccccactgcacccaggtgattaaaagctttattgctcacacgaagcctgtttggtcgtctcttcacacggatgtgcatgaaa

SEQ ID NO: 502 - DNA, 736 bp, Homo sapiens
gtcaggcctctgagcccaagcctgcacgtatacacccagatggcctgaagcaactgaagaatcacagaagaagtgaaaatggccagttcctgccttaactgatgacattccaccattgtgatttgttcctgccccaccttaactgattgattaccttggtgaaattccttctcctcgacaataagtctcagaagctcccccaccgagcaccttgtgacccctgcccctgcccgcaagagaaaaaccccctttgactgtaattttccactactcacccaaatcctgtaaaactgccccacccctatcttccttgctggctctcttttcagcctcagcccacctgcacccaggtgattaaaaagctttattgcggccaggtgcggtggctcacgcctgtaatcctagcactgtgggaggccgaggcaggtggatcacaaggtcaggagaccgacaccatcctgtctaacactatgaaaacctgtctctaataaaaatataaaaaattagccaggcatggtccctgtagtcccaggtactcgggagactgaggcaggagagtggtgtgaacccgggaggtggagcttgcagcaagccgagatcacaccactgcactccagcttgggcgaaagagtgagactccatctcaaaataaataaataaataaataataaaataaaataaagctttattgctcacacaaagcctgttggtggtctcttcacatggacgcgtgtga

SEQ ID NO: 503 - DNA, 126 bp, Homo sapiens
acaggaggtagctagttaggcatgagcagggaagaagagggctccacccacccccaccaggaatgtcaggcaaccatcaggtgatggtcaggcggttgttaactgtctctctaagataataattgg

SEQ ID NO: 504 - DNA, 4926 bp, Homo sapiens
attattacacattgttccctctctagtctttgttcccagtgcaactcatcccaaatcctccttctttccctcctgcctgtcctctcagtcccaaccccaagcgtagctgagtctttctaatcttccttttctacagacccatctgacctctcccctcctccccatgctgctccttaccaggccaagccaggtcccaattcttcctcagtctccactcccccaccctataatccttttatcacctcccctcctcacacctgttccggcttacagtttcattctgcgactagccctcccccaccttcccagcaatttcctcttaaaaaggtggctggagctaaaggcatagtcaaagttaatgctcttttttctttacctgacctctcccaaaatcagttagcgtttaggctctttttcatcgaatctaaaaacccagcccagttcatggcttgtttggcagcaaccctgagacgctttacagccctagaccctgaaaggtcagaaggccgtcttattctcaacatgcattttattttattacctaatctgctcccgacattaaataaagctccaaaaaattaaattccagccctcaaaccccacaacaggacttaattaacctcgccttcaatgtgtacaataatagagtacaggcagccaagtagcaacatatttctgagttgcaattccttacctccactgtgagacaaaccccagtcacatctccagcacacaagaactccaaacgcctaaaccgcagcggccaggcattcctccaggcccgcctctcccagaagcttgctacaagtgccagaaatctggccaccaggccaaggaatgcctgcagcccgggactgctcctaagccgtgtcccatctgtgtgggacccctctggaaatcggactgtccaactcacctggtagccactctcagagaccctggaactctggcccaaggctctctgactccttcccagatcttcttggcttagcagctgaagactgatgctgcccaatcaccttggaagcttcctggaccatcacagacgctttacgtaactctcacagtggaaggtaagtccatccccttcttaatcaatatgcaggctacccactctacattaccttcttttcaagggcctgttccctttcctccataactgttgttggtattgatgaccaggcttaaacctcttaaaactccccaactctggtgacaacttagaccatattcttttaagcactccttttagttatccccacctgcccagttcccttattaggccgagatattttaactaaattatctgcttccctgactattcctgggctacagccatgcctcattgccgccttttcccccagttcaaagcctccttcacatcctccccttgtatctccccaccttagcccacaagtatagaatacctctactccctccttggtgactgatcatgcaccccttaccatcccattaaaacctaatcactcttacccctctcaatgccaatatcccatcccacagcttgctttaaaaggattaaaacctgttatcactcgcctgctacagcatggccttttaaagcctataaactctccttacaattcccccattttacctgtcctaaaaccagacaagccttacaggttagttcaggatctgtgccttatcaatcaaattgttttgcctatctaccccgtgatgccaaacccatatactctcctatcctcaataccttccttcacaacccattattctgttctggatctcaaacatgccttctttactattcctttgcacccttcatcccagcctctctttgctttcacttggattgaccctgacacccattaggctcagcaaattacctaggctgtactgccgcaaggcttcacagacagctcccattacttcagtcaagctcaaatttcttcctcatctgttacctatctgggcataattctcataaaaatgcccgtgctctccctgccgataatgtctgactgatctctcaaactccaacaccttctataaaacaacaactcctttccttcctaggcatagttggatacttttgactttagatacctggttttgccatcctaacaaaaccattatataaattcacaaaaggaaacctagctgaccccatagatcctaaatcctttccccactcctctttctgttccttgaagacagctttagagactgccctcaccctagctctccctgactcattccaacccttttcattatccacagctgaagtgcagggctgtgcagtcggaattcttacacaaggaccgggaccgtgccctgtcgcccttttatccaaacaacttgaccttactgttttgcctagccctcaagtctgcgtgtggtagcctccaccgccctaatacttttagaggcccttaaaatcacaaactatcctcaactcactctctacagttctcataacttccaaaatctattttcttcctcacacctgacacatacactttctgctccctggctccttcagctgtactcactctttgttgagtctcccacaattaccattgatcctggcctggacttcaatccggcctcccacattattcctgatatcacacctgacccccatgactgcatctctctgagccacctgacagtcactccatttccccatattcttccgtgttcctcaccctgaacacacttggtttattgatggcagttccaccaggcctaatcgccattcgccagcaaaggcaggctatgctataatatcttccacatctatcattgagactactgctctgcccccctccactacctctcagcaagccaaactcattgccttaagtcaagccctcactcttgtaaaaggactacacatcaatatttatactgactctaaatatgccttccatatcctgcaccaccatgcaagaggtttcctcactacacaagggtcctctatcattaatgcctctttaataaaaacacttctcaaagctgctttacttccaaaggaaactagagtcattcactgcaaaggccatcaaaaggcatcagatcccatcactcaggacaatgcttatgctgataagatagctaaaaaagcagctagcgttccaacttatatccctcactttcagtttttctccttctcatctggccactcccacctactccccggctgaaacttccacctatcaatctcttcccacacaaggcaaatggttcttagaccaaggaatatatctccttccagcctcaaaggcccattctattctgtcctcatttcataacctcttccatgtaggttacaagccactagcccgtctcttagaacctctcatttcctttccaccatggaaatctatcctcaaggaaatcaattctcagtgttccatctgctattctactactcctcagggattattcaggccccctcccttccctacacatcaagctcggggatttgcccctgcccaggactggcaaattggctttattcaacatgccccgagtcaggaaactaaaatacctcttggtctaggtagacattttcactggataggtagaggcctttcccacagggtctaagaaggccaccatggtcatttcttcccttctgtcaggcataattcctcggtttggccttcccagctctatacagtcctataacagaccggcctttactagtcaaatcacccaagcagtttctcaggctcttggtattcagtggaaccttcatatcccttaccatcctcaatcttcaggaaaggcagaatggactaatggtcttttaaagacacctcaccacgctcagccaacttaaaaaggactggacagtacttttacctctttcccttctcataattcaggcctgtccttggaatgctacaaggtacagcccatttaagctcctgtatagatgctcctttttattaggccccagcctcattccagacaccagaccaatttggactgcaccccaaaaaacttgtcattcctactatcttctgtctagtcatactcctattcactgttctcaactactcataaatgccctgctcttgtttgcactgccagttttcactgtttctccaagccatcacagctgatatctcctggtgctatccccaaactgccactcttaactccctcttaaagtaaataaataatctttgctggcagggctatgctgaatctccttaggcactctaattagatatcctaggtcctcccaattcttagtcctttaatacctgtttttctccttgtcttattccgtttagtttttcaattcatacaaaaccatatccaggccatcaccaatcattctatacaaatgtttcttctaacaaccccacaatatcaccccttaccacaaaatcttccttcagcttaatctctcccactcggctcccatgccgcccctaatcccactcaaagcagccctgagaaacattggccattatctctccataccaacccccaaagttttcgccgccccaacactttaccactattttgttttatttttcttattaatataagaagacaggaatgtcaggcctctgagcccaagctaagccatcatatcccctgtgacctgcacgtatacatccagatggcctgaagtaactgaagaatgacaaaagaagtgaaaatggcctgttcctgcctcaagtgatgatattaccttgtgaaattccttttcctggctcatcctggctcaaaagctcccccactgagcaccttgtgacccccacccctgcccactgagaaaaaccccctttgactgtaattttcctttacctaccccaatcctataaaacggccccaccccatctcccttaaatgactctcttttcggactcagcccgcctgcccccaggtgattaaaaagctttattgctcacacaaagcctg

SEQ ID NO: 505 - DNA, 5762 bp, Homo sapiens
gtcaggcctctgagtccaagctaagccatctcatcccctgtgacctgcacgtatacattcagatggcctgaagtaactgaagaatcacaaaagaagtgatatttaaatggtctgttcctgccttaactgatgacattctaccacaaaagaagtgaaaatggctggtccttgccttaactgatgacattaccttgtgaaattccttctcctggctcatcctggctcaaaaagctttcccactgagcaccttgtgactcctagtcctgcccaccagagaaaaaccccctttgactctaattttcctttacctacccaaatcctgtaaaatggccccacccctatctccctttgctgactctcttttcagactcagtccgcctgcccccaagtgaaataaacagccttgttgctcacacaagcctgtttggtggtctcttcccaaggacactagtgaaattttggtgccatgactcggatcgggggacctcacttgggagattaatcccctgtcctcctgctctttgctctgtgagaaagatccacctatgacctcaggtcctcagaccgaccagcccaaggaacatcacaccaattttaaatcaggtaagcggcctctttttacactctcctccaacctctctcactatccctcaacctctttctcctttcaatcttggcgccacacttcaatctctcccttctcttaatttcagttcctttcctgttctcatagagacaggagatgcattttatctgtggacccaaaactccagcgccggtcagggacttgggatgacagtcttcccttggtatttaatcacacagggatgcctgcctgattattcacccacatttcagaggtgtctgaccacacagggatgcctgccttggtccttcacccttagtggcaagtatcacttttctgggggacaagaaccccccgaccccttctctccatgtctctaccccttctccacttttctggaaggtaagaaccccccgaccacttctctccatgtctctatcccttctctgcttttctagggggcaagaacccccccaccccttctcttcatgtctctactgtctcttttctctgggcttgcctccttcactataggcaagcttccgccctccattcccccttcttctcccttagcctgtgttcttaaaaacctaaaacctcttcaactcacacctgacctaaaacctaaatgccttattttcttctgcaatggcacttgcccccatacaaactcgacagtggttccaaatagccagaaaatggcactttcaatttttccaccctacaagatctaaataattcttgttgtaaaatgggcaaatggtctgaggtgcctgacgtccaggcattcttttacacatcagtccctccctagtctctgttcccaatgcaactcatcccacatcttccctctttccctcccgcctgtcccctcagtcccaaccccaagtgtcactgagtctaatcttccttttctacagacccatctaacctctcccctcctagccaggctgagctaggtccaaattcttcctcagcctccactcctccaccctataatctttttatcacctcccctcctcacacccagtctggcttacactttcattccatgtgtagcccttccccacctgcccagcaatttcctcttaaaaaggtggctggagctaaaggcatagtcaaggttaatgctcctttttctttatcccaaatcagatagcgtttaggctctttttcatcaaatataaaaacccagcccagttcatggcttgtttggcagcaaccctgagatgctttacagccctagaccctaaaaggtcaaaaggccaacttattcttaatatgcattttattacccaatccactcccaacattaaataaaactccaaaaaataaattccggccctcaaaccccacaacaggacttaattaacctcaccttcaaggtgtataataatagaatagagacagccaagtagcaacatatttctgagttgcaattccttgcctccactgtgagacaaaccccagccacatctccagcacagaagaacttccaaacgcctaaaccacagtggccaggcgttcttccaggcccgcctcccccaggagcttgctacaagtgccagaaatctgtccaccaggccaaggaatgcccaaagcctgggattcctcctaagccatgtcccatctgtacgggaccccactggaaattggactgtccaacttacccagaagccactcccagaggccctggaactctggcccaaggctctctgactgactccttcccagatcttctcggcttagcagctgaagactgataccgcccgatcacctcggaagcctgcaggaccatcacagacgctctaggtaactctctcggtggaaggtaagtctgtccccttcttaatcaatatggaggctacccactccacattaccttcttttcaacggcctgtttcccttgcctccataactgttgtaagtactgacagccaggctcctaaacctctaaaaactccccaactctggtgccaacttagacaatactcttttaagaactgcttttcattatccccacctgcccagttcccttattaggctgagacactttaactaaattatctacttccctgactattcctaggctacagccatacctcattgctgccttttcccccagttcaaagcctccttcacatcctccccttgtatctcctcaccttagcccacaagtataagacacctctactccctccttagcaactgatcatgcaccccttaccatcccattaaaacctaatcacccttaccctgctcaatgccaatatcccatcccacagcacgctttaaaaggattaaagcctgttatcattggcctgttacagcatggccttttaaagcctataaactctccttacaattcccccattttacctgtcctaaaaccagacaaggcttacaggttagttcaagatctgcaccttatcaaccaaattattttgcctatcgaccccgtggtgccaaacccatatactctcctattcttaatacctccctccacaacccattattctgttctggatctcaaacattctttctttactattcctttgcacccttcatcccagcctctcttcactttcagttggactgaccctgacacccatcaggctcagcaaattacctgggctgtattgccacaaggcttcacagacagcccccattacttcagtcaagcccaaatttcttcctcatctgttacctatctcagtgtaatcctcataaaaacacacatgctctccctgccgatcatgtccgactgatctctcaaaccccaacaccttctacaaaacaacaactcctttccttcctaggcatggttggatacttttgactttagatacatggttttgccatcctaacaaaaccattatataaactcacaaaaggaaacctaactgaccccatagatcctacatccttttcccactcgttttccgttccttgaagacagctttagagactgcccccaccctagctctcccagactcatcccaacccttttcattacccacagctgaagtgcagggctgtgcagtaggaattcttacacaagaaccaggaccgtgccctgtagcctttttatccaaacaacttgaccttactgttttgcctagccttcaagtctgcatgcagcggccgccaccaccctaatgctttcagaggcccttaaaatcacaaactatgctcaactcactctctacagttctcataacttccaaaatctattttcttcctcacacctgacacatataccttctgcttcccagctccttcagctgtactcactctttgttgagtctcccacaattacctttgttcctggcctggacttcaatctggcctcccacattattcctgataccacacctgacccccatgactgtatctctctgatctacctgatattcaccccatttccccatatttccttctttcctgttcctcaccctgatcacactggtttattgatgtcagttccacaaggcctaattgccacacaccagaaaaggcaggctatgctatagtacaagccactagcccacctcttagaacctctcatttcctttccatcatggaaatctatcttcaaggaaataacttagtgttccatctgctgttctactacttctcagggattattcaggccccctcccttccctacacatcaaactcggggatttgcccctgcccaggactggcaaattggctttactcaacatgcctgagtcaggaaactaaaatacctcttggtctgggtagacactttcactggataggtagaggcctttcccacagggtctaagaaggccaccatggtcatttcttcccttctgtcagacataattcctcggtttggccttcccacctctatacagtcctgtagcggaccagcctttattagtcaaatcatccaagcaatttctcaggctcttagtattcagtgaactaatggtcttttaaaaacacacctcaccaagctcagccaccaacttacaaaggactggacaatatttttaccacttgcctttctcagaattcaggcctgtccttggaatgctacaaggtacagcccatataagctcctgaatagatgctcctttttattaggccccagtctcattccagacaccagaccaacttggactgtgccccagaaaacttgtcatccctactatcttctgtctagtcatactcctattcactgttctcaactactcataaatgccctgctcttgtttacactgctggtttacgctgtttctccaagacatcacagctgatatctcctggtgctattcccaaaccgccactcttaactcttaaagtaaataaataatctttgctggcaaggctatgctgaacctccttaggcactctctaattaggtgtcctgggtcctcccaattcttagtcctttaatacttgtttttctccttctcttattccatttagtttttcaattcatacaaaaccatatccagtccatcaccaataattctacatgacaaatgtttcttctaacaatcccacaatatcaccccttaccacagaatcttccttcagcttaatctctcccactctaggttcccacaccgcccctaatcccgctcgaagcagccccgagaagcatcgcccattatctctccatgccaccccccaaaaaatttttctcactgccccaacacttcaatactattttatgttatttttcttattaatataagaaggccgtaatgtcaggcctctgagcccaagctaagccatcgcatccccctgcatgtatacatccagatggcctgaagtaactgaagaatcacaaaagaagtgatatttaaatggtctgttcctgccttaactgaggacattccaccacaaaagaagtgaaaatggccagtccttgccttaactgatgacattaccttgtgaaattccttctcctggctcaaaaagctcccccactgagcaccttgtaacccccactcctgccctccagagaacaaccaccctttgactgtaattttcctttacctacccaaatcctgtaaaacagccccacccctatctcccttggctgactcttttcggactcagcctgcctgcccccaggtgaaataaacagccttgttgctcacacaagcctgtttggtggtctcttcacagggacgca

SEQ ID NO: 506 - DNA, 503 bp, Homo sapiens
gtggaatgagaccaccgcttctgctgttgtccttcccagcttctccccagcctccccttttccctagtttataagacaggagaaaagggagaaagcaaaaagatggaaagaaacagaagtaagataaatagctagacgaccttggcgccaccacctggccctggtggttaaaataataataataataataatattaacccctgaccaaaactactggtgttatctgtaaattccagacgttgtatgagaaagcactgtaaaactttttgttctgttagctgatgtatgtagcccccagtcacgttcctcacacttactcgatctattatgaccctttcacatggaccccttagagttgtaagcccttaaaagggctaggaatttctttttcggggagctcggctcttaagacgcgagtctgccgatgctcccggccgaataaaaacctcttccttctttaatccggtgtctgaggagttttgtctgtgacttgtcctgctaca

SEQ ID NO: 507 - DNA, 4529 bp, Homo sapiens
gtcaggcctctgagcccaagctaagccatcatatcccctgtgacctgcatgtacacatccagatggccggttcctgccttaactgatgacattgtcttgtgaaattccttctcctggctcatcctggctcaaaagctcccctactgagcaccttgtgacccccactctgcccgccagagaacaacccccctttgactgtaattttcctttatctacccaaatcctataaaatggccccacccttatctcccttcaaggactctcttttcagactcagcccacctgcacccaggtgattaaaagctttattgctcacacaaagcctgtttggtggtctcttcacacagacacgcatgaaatttggtgccgtgactcagatcgggggaccttccttgggagatcaatcccctgtcctcctgttctttgttccataagaaagatccacctacgacctcgggtcctcagaccgaccagcccaagaaacatctcaccaatttcaaatccagtaagcggcctattttcactctcttctccaacctccctcactatccctcaacctctttctcctttcaatattggcgccacacttcaatctctcccttctcttaatttcaattcctttcattttctggtaaagacaaaggagacatgttttatctgtggacccaaaactctggcaccggtcacggactaggaaggcagccttcccttggtgtttaatcattgcaagaacgcctctctgattattcacccacatttcagaggtgtcagaccatgcagggatgcttgccttggtccttcacccttagcggcaagtcccgcttttctaaggggcaagaatccccaatcccttatttccatgccccaacctcttatctctgtgcctcgatcccttatttccatgccccgacctcttatctctgcgccccatcccttatttccgtgccctgacctcttatctctgtgccccaaccccttatttttgcaccctgacccctttctggcttttctggaaggtaagaacccccaaaccccttccctctgtgtctctactctctcttttctctgggcttgcctccttcactataggcaaccttccatgctccactcctccatctcccttagcctgtgctctcaagaacttaaaacctctttgactcacacctgacctaaaacctaaatgccttgttttcttctgcaatgctgcttgaccccaatacaaactcaacagtggttccaaatagccagaaaacggcactttcaatttttccatcctgcaagatctaaataattcttgtcgtaaaataggcaaacagtctgaggtgcctgacgtccaggcattcttttacacatcggtccctccctagtctctgtgcccagtgcaactcgtcccaagtcttccttctttccgtctctcctgtcccctcagtcccatccccaagcgtccctgagtctttctaatcttccttttctacagacccatctgacctctcccctcctccccaggctgctgctcaccaggccgagctaggtcccaattcttcctcagcctccgctcctccaccttgtaatctttttatcacctcccctcctcacacccggtccagtttatagtttcattccgtgactagccctcccccacctgcccagcaatttcctcttaaaaaggtggctgaagctaaaggcatagtcaaggttaatgctcctttttctttatccgacctctcccaaatcagttagcatttagactctttcatcaaacatgaaaaacccagcccagttcgtggctcgttcggcagcaaccctgagacgctttacagccccaaaccctaagaggtcaaaaggctgtcttattctcaatatacattttattacccaatccactcctgacattaaataaaaccccaaaaattaaactccggccctcaaaccccacaacaggacttaattaacctcaccttcaaggtgtacaataataaagtagaggcagccaagtagcaatgtatttctgagctgcagttccttgcctccactgtgagacaaaccccagccacatctccagcacaaaagaactccaaacgcctgaaccgcagtggccagggattcctccagaacctcctccaccaggagcttgctacaagtgccggaaatctggccactgggccaaggaatgcccgcagcccaggattcctcctaagccgtatcccatctgtgtgggaccccactgaaaatcggactgttcaactcacctggcagtcactcccagagcccctggaactctggcccaaggctctctgactccttcccagatcttctcggcttagtggctgaagactgacactgcccgatcacctcggaagccccctagaccatcacggacaccgagcttcaggtaactctcactgtggagggtaagcccatccccttcttaatcaatatggaggctactcactccacattaccttcttttcaagggcctgtttcccttgcctccataactgttgtgggtattgatggccaagcttctaaaccccttaaaactccccgactctggtgccaacttaagacaatactcttttatgcactcctttttagttatccccacctgctcagttcccttattaggccgagacactttaactaaattatctgcttccctgactattcctaggtgacagccacaccacattgccaccttttcccccagttcaaagcctccttcacatcctccccttgtatctccccaccttaacccacaagtataagacacctctactccctccttagcgaccgatcatgcaccccttaccatcccattaaaacctaatcacccttaccccgatcaatgccaatatcccatcccacagcacactttgaaaggattaaaacctgttatcattctcctgttacagcatggccttttaaagcctataaaccctccttaccattccctcattttacctgtcctaaaaccagacgatgcttacaggttagttcaggatctgcgccttatcaaccaaattgttttgcctatccaccccgtggtgccaaacccatatactctcctatcctcaatacctccctctacaacccattattctgttctggatctcaaacatgctttctttactattcctttgcacccttaatcccagcctctcttcgctctcacttggactgaccctgacacccattaggctcagcaaattacctaggctgtactgccgcaaggcttcacagacagcccccattacttcaatcaagcccaaatttcatcctcatctgttacctatctcggcataattctcataaaaacacacgtgctctccctgctgatcgtgtctgattaatctcccaaacctcaatcccttacaaaacaacaactttccttcctaggcatggttagtgcagtcagaattcttacacaagagccaggaccgcaccctgtagcgtttctgtccaaacaacttgaccttactgttttagcctagccctcatgtctgcgtgcagcggctgccactgctttaatacatttagaggccctaaaaatcacaaactatacttaactcactctctacatttctcataacttccaaaatctatttgcttcctcatacctgacgcatatgctttctgctccccggctccttcagctgtactcactctttgttaagtcccacaattaccattgttcctggcccggacttcaatctggcctcccacattattcctgataccacacctgacctccatgactgtatctctctgatccacctgacattcaccccatttcccgatatttccttctttccttttcctcaccctgatcacgcttgatttattgatggcagttccaccaggcctaatcgccacacaccagcaaaggcaggctatgctatagtacaagccactagtccgcctcttagaatctctcatttcctttccatcgtggaaatctgtcctcaaggaaatcacttctcagtgttccatctgctattctactactcctcagggattattcaggccccctcgcttccctacacatcaagctcgaggatttgccccactcaggactggcaaattagctttactcaacatgccccgagtcagataactaaaatacctcttagtctaggtagacactttcactggataggtagaggcctttcctacagggtctgagaaggccaccgctgtcatttcttcccctctgtcagacataattcctcagtttagccttcccacctctatacagtctgataacagaccagcctttattagtcaaatcagccaagcagtttttcaggctcttggtattcagtgaaatctttatatcccttacagtcctccatcttcaggaaaagtagaacggactaaaggtcttttaaaaacacacctcaccaagctcagccaccaacttaaaaaggacggacaatacttttaccactttcccttctcagaagtcagacctgtcctcagaatgctacagggtacagcccatttgagctcctgtatagatgctccttttt

SEQ ID NO: 508 - DNA, 694 bp, Homo sapiens
tatagtaggtagttagtcagacatgagcaggcaggagagggccccccaacccacaccaagaatgtcaggtgatcatcaggtgatgctcaggcagttgttacactgtctctctaaaataataatcggttgcagccaagggagtctcccaagagatagaaaaaccctgaagctggtgatcagcagcatcccaataagatctcaggagttgggtgagtgggctcaagcatgtgcactctgaggcaaaatggcagttaattggtatacgaccttcttttaggaacactcaattggtaagggaaaaacgcctcaagtgagcctgtgcacaattgcagtaaacacaccgtgcctgcagcccctcccaaatgttgacaggccactgtgcatgtggacagccaaccccaagggaagaatcatgggagaagggatgcgaccccctgaaagcatgtcaatgtataaaatcccaagtcaaaggtcaaatcatgcacttgaatctctcaagttgtctgcttgcccttcttccaagtgtactttacatatttcctttcctactctaaaactttttaataaactttcactcctgctctaaaacttgcctcgatctctccctctgccttatgcccctcagtcgaattctttcctctgaggaggcaagaattgaggttgctgcaatcccattcaaatttgccactgctaa

SEQ ID NO: 509 - DNA, 967 bp, Homo sapiens
gtggggaaaagcaagagagatcagattgttactgtgtctgtgtagaaagaagtagacataggagactccattttgttctgtactaagaaaaattcttctgccttgatattctgttaatctataaccttacccccaaccccgtgctctctgaaacatgtgctgtgtcaaactcagggttaaatggattaagggcggtgcaagatgtgctttgttaaacagatgcttgaaggcagcatgctccttaagagtcattaccactccctaatctcaagtacccagggacacaaaaactgccgaaggctgcagggacctctgcctaggaaagccagtattgtccaaggtttctcccgatgtgatagtctgaaatatggcctcgtgggaagggaaagacctgaccgtcccccagcccaacacccgtaaagggtctgtgctgaggaggattagtataagaggaaggcatgcttcttgcagttgagacaagaggaaggcatctgtctcctgcccgtccctggacaatggaatgtctcggtgtaaaacccgattgtacgttctatctactgagatagggaaaaactgccttagggctggaggtgggacatgcgggcagcaatactgctttgtaaagcattgagatgtttatgtgtatgcatatctaaaagcacaacacttaatcatttaccttgtctatgatgcaaagaccttcgttcacgtgtttgtctgctgaacctctccacacaattgtcttgtgaccctgacacatccccctctcggggaaacacccacgaatgatcaataaatactaagggaactcagagtcttgcgggatcctccatatgctgaacgctggttccccgggtccccttatttctttctctatactttgtctctgtgtctttttctttcccaagtctctcgttccaccttatgagaaacacccacaggtgtggaggggcaacccaccccttca

SEQ ID NO: 510 - DNA, 685 bp, Homo sapiens
ttggagtaggtagctaggcacaagtgtgcagaacaggagagggccccctaccaagaatgtcaggcaatgatcagttagttgatggtcaggcggttgttaaactgtctctgtaaaataataattggtcacagccagtgctagggaaaaatagtctcccaatacaaagaaaacacctgaagctggtgattagcagttcctgatagaatctcaggatgagcagtcccaagcatgcacactaagaggcaaagtggccgagtttaactggcctatgaccttcctctagaacactcgactggtaagggaaaaacacctcaagtgaacatgtgcacaacttcagtaaacacactgggcatgtggcccctcccaggccactgcacgtgcagatagcccactccaagagaagaatcaagggagaaaaaatgcaaaccccaggaccaggccaatgtacaaaactgcaagtcaagggccgaatggcacaattggatctttcaagttgccagcttggcttcttccaagtgtactttacatcctttcattcctgctctaaaactttttaacaaactcattcctggtctaaaacttgccttgatttcttcctctgccttaaatctcctcctgctcctcagccaaattctttcctctgaggaggcaaggatcaagtttgctgcagacccattggatttgc

SEQ ID NO: 511 - DNA, 5610 bp, Homo sapiens
gtcaggcctctgagcctaagctaagccatcatatcccctgtgacttgcacatacacatccagatagctggttcctgccttaactgatgacattccaccacaaaagaaatgaaaatggcttgttcctgccttaactgatgacattgtcttgtgaaattccttctcctggctcatcctggctcaaaagctcccctgctgagcaccttgtgacccccccactcctgcccaccagagaacaacccccctttttcctttacctacccaactcctataaaacggccccactcctatctcccttcgctgactctcttttcggactcagcccgcctgcacccaggtgaaataaacagctttattgctcacacaaagcctgtttggtggtctcttcacatggacacgagtgaaatttggtgttggtgccgtgactcggagtgggggacctcccttgggagatcaatcccctgtcctcctgctctttgctccgtgaaaaagatccacctatgacctcgggtcctcagacccaccagcccaaggaacatctcaccaatttcaaatccggtaagcagcctctttttactctcttctccaacctccctcactatctctcaacctctttctcctttcaatcttggcaccacacttcaatctctcccttctcttaatttcaattcctttcactttctggtagagacaaaggagacacattttatccacggacccaaaactccggtgccggtcatggactcgggaaggcagccttcccttggtgtttaatcattgcaaggatgcctctctgattattcacccacattccattggtgtctgatctccgcagggacacctgccttggtcattcacccacgttcccttggtggcaagtcaattgcggggatgcctgctttggctgctccccatcccctactccacgtctctacccttctctttaaacttgcctccttcactataggcaacattccaccctccattcctccttcttctcccttagtctgtgttcttaagaacttaaaacctcttcaactctcgcctgacctaaaatctaagcgtcttattttcttctgcaatgctgcttgaccccaatacaaattcgacggtagttccaaatagccagaaaatggcactttcaatttttccatcctacaagatctaaataattcttgtcataaaataggcaaacggtctgaggtgcctgacgtccagccattcttttacacatcaatccctccttagtctctgttcccaatgcaactagtcccaaatcttccttctttccctcctgcctgtcccctcagtcccaaccccaggtgtcactgagtctttctaatagtccttttctacagactcatctgacttctcccctcctcgccaggctaagtcccaattcttcctcagcctctgctcctccaccctataatccttttatcacctcccctcctcacacctggtctggcttccagtttcattctgtgactagccttcccccacctgcccagcaatttcctcttaaaaaggtggctagagctaaaggcatagtcaaggttaatgctcctttttctttatcccaaatcagatagcgtttaggctctttttcatcaaatataaaaacccagcccagttcatggctcgtttggcagcaaccctgagatgctttacagccctagaccctgaaaggtcaaaaggccgtcttattctcaatatacattttattacccaatctcctcccgacattaaataaaactccaaaaattaaattccggccctcaaactccacaacaggacttaattaacctcgccttcaaggtgtacaataatagagtagaggcagccaagtagcaacatatttctgagttgcaattccttgcctccactatgagacaaaccccagccacatctccagcacacaagaacttctaaacgcctaaacctcagtggccaggcattcctccaggcctgcctcccccaggagcttgctacaagctctggaaatctggccactgggccaaggaatgcccacagcccaagattcctcctaagctgtgtcccatctgtgcaggaccccactgaaaatcggactgttcaactcacctggcagccacttccagagcccctggaactctggcccaaggctctctgactccttcccagatcttctcagcttagcagctgaagactgatactgccggattgcctcagaagcctacaagaccatcacagacgctctaggtaactctcacagtggaaggtaagtccatccccttcttaatcaatacggaggctacccactccacattaccttcttttcaaaggcctgtttcccttgcctccataactgttgtattgacagccaggtttctaaacctcttaaaactccccagctctggtgccaacttagacaatactcttttaagcaatccttttagttatccccacctgcccagttcccttattaggccgagatattttaactaaattatctgcttccctgactattcctgggctacagacacacctcattgccaccttttcccccagttcaaagcctccttcacatcctccccttatatctccccaccttaacccacaagtataagatacctctactccctccttagcgacctataatccaccccttaccatctcattaaaacctaatcacccttaccccgctcagtaccaatatcccatcccacagcacgctttaaaaggattaaagcctgttatcactcacctgttacagcatggccttttaaagcctataaactctccttacaattcctccattttacctgtcctagaaccagacaagccttacaggttagttcaggatctgcaccttatcaaccaaattattttgcctatccaccctatggtgccaaacccatatactctcctatcctcaatacctccctccacaacccattattctgttctagatctcaaacatgctttctttactattcctttgcacccttcatcccagcctctcttcgctttcacttggactgaccctgacacccatcaggctcagcaaattacctgggctgtactgctgcaagcttcacagacagcccccattacttcagtcaagcccaaatttcttcctcagctgttacctatctcagcgtaattctcataaaaacacacgtgctctccctgctgatcctgttcagctgatatctcaaaccccaacagctataaaacgacaactcctttccttcctgggcatggttagacactttcgactttagatacctggttttgctatcctaacaaaaccattatataaactcacaaaaagaaacctagctgaccccatagatcctaaatcctttccccattcctctttccgttccttgaagacagctttagagactgcccccaccctagctctccctgacaaatcccaacccttttcattacccacagccaaagtgcaggcctgtgcagttagaattcttacacaagaaccaggactacaccctgtagcctttttatccaaacaacttgaccttactgttttgcctagccctcaagtctgcgtgcagtggccaccactgccctaatacttttagaggcccttaaaatcacaaactatgctcaactcactctcaacagttctcataacttcctcacacctgacgcatatactttctgctccccagctattttcttcctcacacctgacgcatatactttctgctccccagctccttcagctgtactcactctttgttgagtctcccacaattaccattgttcctggtccggacttcaatccggcctcccacattattcctgataccacacctgacccctatgactgtatctctctgatgcacctgacattccaccccatttccccatatttccttctttcctattcctcaccctgatcacacttagtttattgatggcagttccaccaggcctaatcaccacaccagcaaaggcaggctatgctatagtataagccactagcccgcctcttagaacctctcatttcctttccatcgtagaaatctatcctcaaggaaataacttctcagtgttccatctgctattctactacccctcagggattattcaggccccctcccttccctacacatcaagctcaaggatttgcccccacccaggactgggaaagtagctttactcaacatgccctgagtcaggaaactaaaatacctcttagtctaggtagacactttcactggataggtagaggcctttcccacagggtctgaaaaggtcaccgcagtcatttcttcccctctgtcacacataattcctcgctttggccttcccacctctatacagtccaatagcagaccggcttttcaggctcttggtattcagtgaaacctttataccccttacggtcctcagtcttcagaaaaggtagaacagactaatagtcttttaaaaacacacctcaccaagctcagccaccaacttaaaaagaactggacagtacttttaccactttcccttctcagaattcaggcctgtcctcggaatcctacaaggtacagcacatttaagctcctgtatggacgctcctttttattaggccccagtcttattccagacaccagaccaacttaagactgtgccccaaaaaaacttgtcatccctactatcttctgtctagtcatactcctgttcactgttctcaactactcatacgtgccctgctcttgtttacactgccagtttacactgtttctccaagctatcacagctgatatctcctggtgctatccccaaactgccactcttaactcttaaataaataatctttgctggcagaactatgctaaatctccttaagcactctctaattacatgtcctaggtcctccccattcttagaactttaatacctggttttctccttctcttattccatttagtttttcaattcatataaaaccgtatccaggccatcaccaataattctacatgacaaatgtttcttccaataaccccacaatatcaccccttaccacaaaatcttccttcagcttaatctctcccactccaggttcccacgcctcccctaatcctgagaaacatcacccattctctctctccataccaccccctgccaaaaatgtttcgccgccccaacacttcgacactattttgttttattcttcttattaatataagaagacaggaacgtcaggcctctgagcccaagctaagccatcatatcccctgtgacctgcacatacacatccagatggccggttcctgccttaactgatgacattccaccacaaaagaagtgaaaatggcctgttcctgccttaactgatgacattgtcttgtgaaattccttctcctggctcatcctggctcaaaaagctcccccactgagcaccttgtgacccccactcctgcccaccagagaacaacccccctttttcctttacctacccaaatcctataaaacggccccacccctatctcccttcgctgactctctttttggactcagcccgcccgcctgcacccaggtgaaataaacagctttattgctcacacaacgcctgtttggtggtctcttcacacggacgcgagtgaaa

SEQ ID NO: 512 - DNA, 5794 bp, Homo sapiens
gtcaggcctctgagcccaagctaagccatcatatcccctgacctgcacgtacacatccagatggtgggttcctgccttaactgatgacattccaccacaaaagaagtgaaaatggcctgttcctgccttaactgatgacattccaccacaaaagaagtgaaaatggcctgttcctgccttaactgatgacattgtcttgtgaaattccttctcctggctcatcctggctcaaaggctcccccactgagtaccttgtcacccccattcctgcccaccagagaacaacccccctttttcctttacctacccaaatcctacaaaacggccccacacctatctctcttcactgactctcttttgggactcagcccgcctgcacccaggtgattaaaagctttgttgctcacacaaagcctgtttggtggtctcttcacacagatgcgtgtgaaatttggtaccgtgactcggatctggggacctcccttgggagatcaatcccctgtcctcctgctctttgctccatgagaaagatccacctacgacctcaggtcctcagactaaccagcccaagaaacatctcaccaatttgaaatccagtaagtggcctctttttactctcttctccaacctccctcactatccctcaacctctttctcctttcaatctcggtgccacacttcaatctctccctgctcttaatttcagttcctttcattttctggtagagacaaaggagacacattttatccgtggacccaaaactccggcgccagtcatggactaggaaggcagccttcccttggtgtttaatcatcacagagatgcctctctgattattcacccatgtttcagaggtgtcagaccacgcagggatgcctgccttggttcttcacccttagcggcaagtcctgcttttctgtgggaggggcaagtactccaaccccttctctccatgtctctaccccttctccacctttctggggggcaagaaacccccaaccccttctacttcacccttagcagcaagtcccacttttctaggggaggggcaagtaccccaaccccttatatctctgtgtcccgatcccttatttccgtgccccaacctcttatatctctgtgccctgatcccttatttccatgccctgacctcatatctctgtgccctgatccctttcccacttttctggagggtaagaacccccgaaccccttctctccatgtctctactctcttttctctgggcttgctgccttcactatgggcaaacttccaccctccattcctccttcttctcccgtagccggtgtttttaagaacttaaaacctcttcaactctcacctgacctaaaatgtaagcatcttattttcttctgcaatgctgcttgaccccaatacaaacttgacagtagttccaaatagccagaaaatggcactttcaatttttccatcctgcaagatctaaataattcttgtcgtaaaatgggcaaacggtctgaggtgcctgatgtccaggcattctgttacacatcggtccctccctagtctctgtgcccagtgcaacttgtcccaaatcttccttctttccctctcacttgtcctctcagtcccaaccccaagggttgctgagtttttctaatcttccttttctacagacccatctgacctctcccatcctccccaggctgctcctcaccaggccaagctaggtcccaattcttcctcagcctctgctcctccaccctataatctttttatcacctccccccctcacacccagtctggcttacagtttcattccctgagtagccctcccccacctgctcagaaatttcctcttaaaaaggtggctgaagctaaaggcatagtcaaggttaatgctcctttttctctatcagacctctcccaaatcagtgagcatttaggctctttcatcaaatatgaaaaacccagcccagttcatggctcattcagcagcaatgctgagacactttacagacctagaccctaaaaggtcaaaaggctgtcttattctcaatatacattttattacccaatctgctcctgacattaaataaaactccaaaaattaaattccggccttcaaaccccacaacaggatttaattaacctcaccttcaaggtgtacaataatagaaaaaagttgcaattccttgcctccactgtgagacaacccccagccacatctccagcacacaagaagttccaaatgcctaaaccgcagtggccagacattcctccagaaccaccttccccaggggcttgatcaggcctcctccctttcctacacatcgagctcagggatttgcccctgcccaggactggcaaattgactttactcacacgcctcaagtcagaaaactaaaatatctcttagtctgggtagacactttcactggatgggtagaggactttcccacagggtctgagaaggccaccgtggtcatttcttcccttctgtcagacataattcctcagtttggccttcccacctctatacagtctgataacggaccagcctttactagtcaaatcacccaagcagtttctcaggctcttggtattcagtggaaccttcatatccattaccatcctcaatcttcaggaaaggtagaatgcactaatggtcttttaaagacacacctcaccaagctcagcctccaacttaaaaaggcttggacaatacttttacctcttgcccttctcagaattagagcctgtcctcgagatgctacagggtacagtccttttgaacttttatatggatgcactttcttgcttggccccaacttcatcccagacaccagctctctaggtgactatcttccagtcatccaacaggctagataggaaattcatcaggctgctaatcttctcttgcctattccagatccccagccatatgaagacaccctagctggacaatcagttctttataagaatctgacccctcaaactctacaacctcgatggaccggaccctacttagtcatctctagtaccccgattgccatcggcctgcaggatcctccccactgggttcaccattccagaataaagctgtgtccattggactgccagcctaatccctcctcttcctcctggaagtcgcaagtactctcccctacttcccttaaactcactcatatttctgaagaacagtgataacccttatgagcctaatacatcccttcattctattagatctgttcatccttaccctacattttcaacagggctttacgatgtcactcccaccacttgggccgagcaccaaaaaacttgtcatccctactattttctgtctagtcatactcctattctccattctcaactacttataaatgccctactcttgtttacactgccggtttacactgtttcttcaagccatcacagctgatatctcttggtgctatccccaaactgccactcttaattccctcttagagtgtgtagatgatctttgctgtcagggcactctccaatacttccaccctgatgaagttctattctttacttttatactcactcttattctcattcctattcttatgccaccctttacctctgcccagctatcttcaccacactatcaaccttgcccattctctcctagccacttctaatccctccttagtgaacaactgctggctttgtgtttccctttcttcctgtgcctacacagctgtccccgccttacagacagactgggcaacatctcctgtctccttacacctctgaacttcctttaacagctctcacctttaccctcctgaagaactcatttactttctagacaggtccagcaagacttccccagacatttcacatcagcaagctgccgccctcctctgcacttatttaaaaaacctttctccttatattaactctactccccccatatttggacctctcacaacacaaactactattcctgtggccgctcctttatgtatctctcagcaaagacccactggaattcccctaggtaatctttcaccttctcgatgttcctttactcttcatgtctgaagcccaactacacacatcactgaaacaattggagccttccagctccatattacagacaagacttctatcaatactgacaaactcaaaaacgttagcagtaattattgtttaggaagacacttaccctgcatttcactccatccttggctaccttctgcttgctcatcagactctcctcccaggccctcttcttgtttacttatacccagccccgaaaataacagtgaaagtttgctcatagatacttaacgttttctcatacaccatgaaaattgaacctcctcctctatgcagttactccatcagtccccattacaacctctgacagctgccgccctagctggatccctaggagtctgggtacaagacaccgctttcagcactccttctcacctttttactttacatctccagttttgcctcacacaaggtctcttcttcctctgtggatcccctacctacatgcgtctacctgctaattggacaggcacatgcacactagttttccttacccccaaaattcaatttgcgaatgggacggaagagctccttgttcctcgcatgacaccgacatgacaaaaaagagttattccactaattcccttgatggtccatttaggactttctgcctccactattgctctcggtactggaatagcaggcatttcaacctctgtcacgaccttctgtagcctgtctaatgacttctctgctagcatcacagacatatcacaaactttatcagtcctccaggcccaagttgactctttagctgcagttgtcctccaaaaccgccgaggccttgacttactcactgctgaaaaaggaggactgtgtatattcttaaatgaagagtgttgtttttacctagatcaatctggcctggtgtatgacaacataaaaaaactcaaggatagagccccaaaacttgccaaccaaacaagtaattatgctgaatccccttgggcactctccaattggatgtcctgggtcctcccaattcttagtcctttaataaccatttttctccttcttttatttggaccttgtatcttccgtttagtttctcagttcatccaaaaccgtatccaggccatcgccaatcattctatactacaaatgtttcttccaacaaccccacaatatcaccccttaccacaagatctcccttcagcttaatctttcccactctaggttcccacactgcccctaatcccgctcaaagcagcctgagaaacatcgcccattatctctccataccaccccccaaaaatttcaccgtcccaacactttaccactatttcattttatttttcttattaatataagaagacaggaatgtcaggcctctgagcccaagctaagccatcatatcccctgtgacctgcacgtacacatccaggtggcctgttcctgccttaactgatgacattccaccacaaaagaagtgaaaatgacctgttcctgccttaactgatgacattgtcttgtgaaattcttctcctggctcatcctggctcaaaagctcccccactgagtaccttgtgacccccactcctgcctgccagagaacagccccccattttcctttgcctacccaaatcctataaaacagccccaccctatctcccttcactgactcttttcggactcagcccgcctgcacccaggtgattaaaagctttattgctcacacacagcctgtttggtggtcttttcacacggatacgcatgaaa

SEQ ID NO: 513 - DNA, 5542 bp, Homo sapiens
gtcaggcctctgagcccaagctaagccttcatatcccctgtgacctgcacgtatacatccagatggcctgaagtaactgaagaatgacaaaagaagtgaaaatggcctgttccttccctaactgatgacattaccttgtgaaattcctgctcctggctcatcctggctcaaaagctcccctgctgagcaccttgtgaccccccacccctgcccgccagagaacaacccctctttgactgtaattttcctttacctacccaaatcttatgaaacggccccacccctatctcccttcactgactcttttcagactcagcctgcctgcacccaggtgaaataaacagccttgttgctcacacaaagcctgtttggtggtctcttcacacggacgtgagtgaaattttggtgccgtgactcagatcagcggacctcccttgagagatcaatcccctgtcctcctgctctttgctccacgagaaagatccacctacgacctcgggtcctcagactgaccagcccaaggaacatctcaccaactttaacactgctaagcagcctctctttactctcttctccaacctctctcactatccctcaacctctttctcctttcaatcttggcgccacacttaaatttctcccttctcttaatttgggagttgtcagtgcataaatggaggctgaagctcagatgtcaggcagaccaccaggagcaagagcaaagactgaggggagggcaaagacagaggggagagcaaagacagaggggagtttctttccttttctggtagacactaaggagacgcgttttatccatgaacccaaaactctggcaccggtcatggactcaggaagacagtcttcccttggtgtttaatcgtgcagggatgcctgcctgattattcacccacgtttcagaggggtctgcacaagtggggacacctgccttggtccttcacccttagcagcaagcaccacttttctggggggcaagcaccccccgaccccttctctccatgtctctaccccttttccactttcctggggggcaagcaccccccaacacttctctccatgtctctaccctctcttttctctggacttgcctccttcactacagtcaaccttctaccctccattcctccttctcccttagcctgtgttctcaaaaacttaaaacctcttcaactcacacctgacctaaaacctaaacgccttattttcttctacaatgccgcttgaccccaatacaaactcgacaatggttccaaatagccagaaaatggcacttttgattttttccatcctacaagatctagataattcttgtcgtaaaatgggcaaatggtctgaggtacctgacgtccaggcattcttttacacataggtccctccccagtctgttcccaaggcaactcgtcccaaatcctccttctttcgctcctgcctatcccctcagtcccaaccccaagtgtcgctgagtctttctaatcttccttttctacagacccatctgacctctcccctcctccccaggctgctcttcgccaggccgagctaggtcccaattcttcctcagcctccactcccccaccctataatccttttatcacctcccctcctgacacccagtcctgcttacagttttgttcctcaactagccctcccccacctgcccagcaatttcctcttaaaaaggtggcaggagctaaaggcatagtcaaggttaatactcctttttctttatccaacctctcccaaatcagttaacgtttaggctctttttcatcaaatataaaaatccagcccagttcatcacttgtttggcagcaaccctgagacgctttacaaccctagaccctgaaaggtcagaaggccatcttattctcaatatgcattttattacccaatctgctcccaacattaaataaagctccaaaaattaaattccagccctcaaaccccaaaacaggacttaattaacctcaccttcaaggtgtacaataatagagaggaggcaccaggcagcaacgcatttctgagttgccaattccttgcctccactgtgagacaaaccccagccacatctccagcacacaagaactccaaatgcctgaaccgcagctgccagaggttcccccagaacctcctcccccagcttgctacaagtgccagaaatctggccactgggccaaggaatgcccacagcccaggattcctcctaagccgtgtcccatctctgcaggaccccactgaaaatcggactgtcaactcacctggcagccactcccagagcccctggaactctggcccaaggctctctgactccttcccagatcttcttggcttagcggctgaagactgacgctgcccgatcacctcagaagccccctggaccatcatggatgctgagctttggataactcttacagtgaagggtaagtccatccccttcttaatcaatatggaggctacccactccacattgccttcttttcaagggcctgtttcccttgcctccataactgttgtgggtattgatggccaggcttctaaaccccttaaaactccccacctctggtgccaacttggacaatattcttttatgtactcctttttagttatctccccctgcccagttcccttattaggccgagcattttaactaaattatctgcttccctgactattcctaggctacagccacacctcattgctgcccttttccccagttcaaagcctccttcacatcctccccttgtatctccccaccttaatctactagtacaactctactccctccttggcgactgatcatgcaccccttaccatcccattaaaacctaatcacccttaccccactcaacgccaatatcatatcccacagcatgctttaaaaggattaaagcctgttatcactcgcctgctacagcatggccttttaaagcctttaaactccccttacaattcccccattttgccagtcctaaaaccagacaaggcttacaggttagttcaggatctgtgccttatcaaccaaattgttttgcctatccaccccatggtgccacccatataactctcctatcctcaatacctccctccgtacccattactctgttctggaactcaaagatgctttctttactattcctttgcacccttcatcccagcctctctttgctttcacttggactgaccctgacacccatcaggctcagcaaattgcctggcgtgtactaccgcaaggcttcacagacagcccccattacttcagtcaagcccaaatttcttcctcatctgttgccatctcagcataattctcataaaaacactcgtgctctccctgctgatcgtgtccaactaatctcccaaatcccaatcccttctacaaaacaccaactcctttccttcctaggcatggttagttcggtcagaattcttacacaagagccaggaccatgccctgtagccattctgtccaaacaacttgacattagtgttttagcctagccctcatgtctgcgtgcagtggctgctgctgtcttaatactttcacaggccctcaaaatcacaaactatgctcaactcactctctacagttctcataacttccaaaatctattttcttcctcacacctgacgcatatattttctgcccccgtccactacccctcagcaaactgaactcattgccttaacttgaaccctcactcttgcaaagggactatgcgtcaatatttatactgactccaaatatgccttccatatcctgcaccaccatgctgttatacaggcagaaagagattttctcactatgcaagggtcctccatcattaatgcctctttaataaaaactcttctcaaagccactttacttccaaaggaagctggagtcattcactgcaagagccatcaaaaggcatcagatcccatcgctcaggacaatgcctatactgataaagtagctaaaaaaaaaagcagctagtattccaacttctatccctcatggcagtttttctccttctcatctggccactcccacctactcccccactaaaacttccatctatcaatctcatcccacacaaggcaaatggttcttagaccaaggaaaatatctccttccagcctcacaggcccattctattctgtcatcatttcataacctcttccatgtaggttacaagccactagcccgcctcttagaacctctcatttcctttccatcatggaaatctgttcttaaggaaatcacttcttagtgttccatctgctattctcctactcctcagggattgttcaggccccccaccttccctacacatcaagctcggggattttcccctgcccaggactggcaaattgactttactcacatgcctccagtcaggaaactaaaatacctctgggtctgggaagacactttcacaagatgctagaggcctttcccacagggtctgagaaggccaccacagtcatttcttcccttctgtcagacataattcctcggattggccttcccacctctatacagtctggtaatgaaccggcctttactaggtcaaatcacccaagcagtttctcaggctcttggtattcagtggaaccttcatatcccttaccgtcctccatcttcaggaaaggtagaacggacaaatggtcttttaaaaacacaactcactaagctcagcctccaacttaaaaaaaagactctgtcaagaatagagccaaaaactcaccaaccaagcaactaattacactgaacccccttggacactctctaattggatgtcctgggtcctcccaattcttagtcctttaatacctgtttttctcctcctcttattctgtttacgttttcaattcatacaaaaccacatccaggccatcaccaataattctacatgacaaatgtttcttctaacaaccccacactatcaccccttaccacaaaatcttccttcagcttaatctctcccactttaggttcccacgctgccccaaatctcgctcgaagcagccctgagaaacatcgcccattatctctccataccaccctccaaaattttcgccaccccaacactttaccactattttgttttattttttcttattactataagaagataggaatgtcagggcctctgagcccaagctaagccatcgtatcccctgtgacctgcatgtatacatccagatggcctgaagtagctgaagaatgacaaaagtgaaaatggccagtccctgccttaactgatgacattaccttgtgaaattccttctcctggctcatcccggctcaaaagaccccctgctgagcaccttgtgaccacccccccaacccctgcccaccagagaacaaaccccctttgactgtaattttcctttacctacccaaatcttataaaacggccccacccctatctcccttcactgactctcttttcggactccgcctgcctgcacccaggtgaaataaacagccttgttgctcacacaaagcctgtttggtggtctattgacaggcatacgagtgaaa

SEQ ID NO: 514 - DNA, 762 bp, Homo sapiens
gagagacaggactagctggatttcctaggctgactaagaattcctaagcctagctggggaaggtgactacacctacctttaaacatggggcttgcatctcagctcacaccctaccagtcaggtagtaaagagggctcactaaaatacaaattaggttaaaagcaggaggtaaagaaatagtcaaatcatatatcacctgagagcacaggaggagggacaatgatcaggatataaacccaagcattccagcagggagcggcaaccccctttgggtcctctcccattgtatgggagctctgttttcactctattaaattttgcagctgcacactcttctggtctgtgtttgttacggcttgagctgagcttttgctcaccatccaccactgctgtttgctgccgtcacagacccgccgctgacttccacccctctgaatccagcagggagtccgctgcgctcctgatccagcgaggcgcccattgccgctccagttcaggctagaggctcgccattgttcctgcatggctaagtgcccgggtttgtcctaatctaactgaacactagtcgctgggttccgtggttctcttccttgacccacgttttctaatagaacaataacactcactgcatgacccaaggttccattccatggaatccatgaggccaagaaccccaggtcagagaacaaaaggcttgccgccatcttgggagcggctcaccaccatcttgagagcactaagaacaaagacctgcctgtaaca

SEQ ID NO: 515 - DNA, 5707 bp, Homo sapiens
gtcaggcctctgagcccaagccaagccatcacatcccctgtgacttgcacgtatacgcccagatggcctgaagtaactgaagaatcacaaaagaagtgaatatgccctgccccaccttaactgatgacattccaccacaaaagtgtaaatagccggtccttgccttaagtgacgacattaccttgtgaaagtccttttcctggctcatcctggctcagaaagcacccccactgagcaccttgcgacccccactcctgcccgccagagaacaaaacccctttgactgtaattttcctttaccttcccaaaacctataaaacagtgccacccttatctcccttcgctgactctctctttggactcagcccgcctgcacccaggtgaaataaacagccatgttgctcacacaaagcctgtttggtggtctcttcacgccgacgcacatgaaatttgatgccgtgacttggatctggggacctcccttgggagatcaatcccctgtactcctgttctttgctccgtgagaaagatccacctatggcctcaggtcctcagactgaccagcccaaggaacatctcatcaattttaaatcaggtaagcggcctcttcttactctcttctccagcctctctcactgtccctcaaccactttctcctttccactcttcaatctctcccttctcttaatttcaattcctttcattttctgggagagacaaaggagacacgttttatccgtggacccaaaactccggtgccggtcacggactgggaaggcagccttcccttggtgtttaatcattgcagggacacctctctgattatacacccacgtttcacgggtgtcagaccacgcagggacgcctgccttggtccttcacctttagcggcaagtcccgcttttctgagggaggggcaagtacccctcaaccccttctctttcacccttagcggcaagtcccgcttttctagggggcaagaatgtccaataccttatttccgcaccccaacctagtatctccatgccccaatcctttatttccatgccccgaccccttatttccgtgccccgaccccttatttctgcaccccatcccttatttccgtgccccgaactcttatatctgcaccccaaccccttttctcacttttctgaaaggtaagaatccctgaaccccttccctccgtttctctactctctcttttctcgaggcttgcttcctccactataggcaaacttccaccctccattcctccttctactcccttggcctgtgttctcaaaaacttaaaacctcttcaactcacacctgacctaaaacctaaatgccttattttcttctgcaatgccgcttgaccccaatacaaactcaacagtagttccaaatagccagaaaatggaactttgaatttctccatcctgcaagatctaaataattcttgtcataaaataggcaaatgatctgaggtgcctgacgtccaggcattcttttacacatcagtcccttcctagtctctgtgcccagtgcaactcatcccaaatcttctttccctcccacctgtcccctcagtcccaatcccaagcgtcgctgagtctttctaatcttccttttctacagacctatctgacctctcccctcctcgccagcccgagctaggtcccaattcttcctcagcctccgctcctccaccctataatctttttatcgcctcccctcctcacacctggtcgggcttacagtttcgttctgtgactagccctcccccacctgcccagcaatttactcttaaaaaggtggctggagccaaaggcatagtcaaggttaatgctcctttttctttatcccaaatcagaaccgtttaggctctttttcatcaaatataaaaatccagcccagttcatggatcgtttggcagcaaccctgagacactttacagccctagaccctaaaaggtcaaaaggctgtcttattctcaatatacattttattatccaatctgctccccacattaaataaaactccaaaaattaaattccggccctcaaaccccacaacaggatttaactaacctcgccttcaaggtgtacaataatagaaaaaagttgcaattccttgtccccactgtgagacaaaccccagccgcatctccagcacacaagaacttccaaacgcctgaaccgcagcggccaggtgttcctccagaacctcctcccccaggagcttgctacaagtgccagaaacgtggccaccaggccaaggaatgcctgcagcccaggattcctcctaagccacgtcccatctgtgccggaccccactggaaatcggactgtccaactcacctggcagccactcccagagcccctggaactctggcccaaggctctctgactgcttcccagatcttcttggcttagcggctgaagactgacgctgcctgattgcctcggaagccccctagaccatcacggatgcccagcttcaggtaactctcacagtggaaggtaagcccgtccccttcttaatcaatacggaggctacccactccacattaccttcttttcaagggcctttttcccttgcctccacagctgttgtcggtattgatggccaggcttctaaacctcttaaaactccccaactctggggccaacttagacaatactcttttaagcactcctttttagttatccccacctgcccagttcccttattaggctgagacactttaactaaattgtctgcttccctgactattcctggactacagctgcatctcattgctgcccttcttcccaatccaaagcctcctttgcatcctcctcttgtatcccccaaacttaacccgcaagtataaaatacctctactccctccttggtgactgatcatgcaccccttatcatctcattaaaacctaatcacccttacgccactcaaccccaatatcccatcccgcagcacgctttaaaaagattaaagcctgttatcactcgcctgctacagcacggccttttaaagcctataaactctccttacaattcccccattttacctgtcctaaaaccagacaagccttacaagttagttgaggatctgcgccttattaaccaaattgttttgcctatccacccagtggtgccaaacccatatattctcctatcctcaatacctgcctctataacccattattctgttctggatctcaaacatgctttctttactattcctttgcacccttaatcccagcctctcttcactttcacttagactgaccctgacacccatcaagctcagcaaaatacctaggctgtactgctgcaaagcttcacagacagcccccattacttcaatcaagcccaaatttcttcctcatctgttacctatctcggcataattctcataaaaacacacgtgctctccctgctgatcgtgtccgactaatctctcaaaccccagcaccttctacaaaacaacaactcctttccttcctaggcatggttagtgcggtcagaattcttacacaagagccaggaccacaccctgtagcctttctgtccaaacaacttgacctactgttttagcctagccctcatgtctgcgtgcagtggctgccgctgcattaatacttttagaggccctcaaaatcacaaactatgctcaactcactctctacagttctcataacttccaaaatctattttcttcctcatacctgatgcatatactttctgctccccggctccttcagctgtactcactctttgttgagtctccctcaattccattgttcctggcccagacttcaatccagcctcccacattattcctgataccacacctgacacccaggactgtatctctccgatccacctgacattcaccccatttccccaaatttccttctttcgtgttcctcactctgatcacacttgatttattgatggcggttccaccaggcctaatcgccacacaccagcaaaggcaggttatgctatagtacaagccactagcccacctcttagaacctctcatttcctttccatcgtggaaatctatcctcaaggaaataacttctcagtgttccatctgctattctactactactcaaggattattcaggccccctcccttccctacacatcaagctcgaggatttgcccccacccaggactggcaaattagctttactcaacatgtcctgagtcagataactaaaatacctcttagtctaggtagataatttcactggataggtagaggcctttcccacagggtctgagaaggccacctcagtcatttcttcctttctgtcagacataattcctcagtttagccttcccacctcaacacactcttataacagaccagcctttattagtcaaatcagccaagcagtttttcaggctgttagtattcagtgaaacctttatatcccttacggtcctccatcttcaagaaaagtagaatggactaaagatcttttaaaaacacacctcaccaagctcagccaccaacttaaaaaggactggacaatactttaaccactttcccttctcagaattcaggcctgtcctcggaatgctacagggtactgcccatttgagctcctgtatagacgctcctttttattaggccccagtctcattccagacaccagaccaacttagactgtgccccaaaaaacttgtcatccctattatcttctgtctagtcatactcctattcaccgttctcaactactcatacatgccctgctcttgtttacactgccggtttacagtttctccaagccatcacagctgatatctcctcgtgctatccccaaactgccactcttaactcttgaagtaaatacataatctttgctggcaggactatgctgaatctccttaggcactatctaatcagatatcctgagttgtcccaattcttagaacttttatacctgtttttctccttctgttattccatttagtttctcaattcatccaaaaccatatccaggccataaccaataattctacacaacaaatgtttcttctaacaaccccacaatatcaccccttaccacaagacctcccttcagcttaatctctcccactctaggttcccacgctgcccctaatcccgcttgaagcagccctgagaaacatcacccattctctctccatatcaccccccaaaaattttcactgccccaacacttcaacactattttgttttatttttcttattaatataagaaggcaggaatgtcaggcctctgagcccaagccaagccattgcatcccctgtgacttgcacatataagcccagatggcctgaagtaactgaagaatcacaaaagaagtgaatatgccctgccccaccttaactgatgacattccaccacaaaagaagtgtaaatggccggtccttgccttaagtgatgacattaccttgtgaaagtccttttcctggctcatcctggctcaaaaaacacccccactgagcaccttgggacccccactcctgcccgccaaagaacaaaccccctttgactgtaattttcctttacctacccaaatcctataaaacagccccacccctatctcccttcgctgactctctttttggactcagcctgcctgcacccaggtgaaataaacagccatgttgctcacacaaagcctgtttggtggtctcttcacatgcacgagcatgaaa

SEQ ID NO: 516 - DNA, 706 bp, Homo sapiens
ttacagcaggtagctagtcagacgtgaaagggcaggagagcatccccctgccaccccccaacaaacaagaatgtcaggcaaccatcaggtgatggtcagtcggttgttgttaaaactgcctctctaaaataataattggttgcagctggcaccagggaaaggcagtctcccaatagagaaagacacctaaagctcatgatcaacagcttcctgataagatctcaggagttgggtgagtgggctcagtcatgcacactaagaggaaaaatggtggagtttaattgttatatgactttccaggagcattcaactggtaaggggggatgcctcaagtgagcatgcgcgcaactccggtaaacacactgcgcatgcggcccctgccaagtgctggcaggccactgtgcatgtgggcagcccactccaaggaaagaatcagggagaaaggaacacaagaccccggaagcacgccaacacataacacaccaggtcaaagggtcaaactgcacacttgatctcccaagttgcccacttgaccctcttccaagtgttctttacttcctttcattcctgctctaaagcttttaaataaacttttactcctgttctaaaacttgcttcagtctcactctgccttatgccccttggtcaaattatttcttctgaggcggcaagaactgaggttgctgcagacccatacatatatgcc

SEQ ID NO: 517 - DNA, 9137 bp, Homo sapiens
gtggggaacagcaagagagatcagattgttactgtgtctgtgtagaaagaagtaggcataggagactccattttgttatgtactaagaaaaattcttctgccttgagattctgtgaccttacccccaaccccgtgctctctgaaacatgtgctgtgtcaactcagagttgaatggattaagggcggtgcaagatgtgctttgttaaacagatgcttgaaggcagcatgctccttaagagtcatcaccactccctaatctcaagtacccaaggacacaaaaactgcagaaggccgcagggacctctgcctaggaaagccaggtattgtccaaggtttctccccatgtgatagtctgaaatatggcctcatgggaagggaaagacctgactgtcccccagcccgacacccgtaaagggtctgtgctgaggaggattagtaaaagaggaaagaatgcctcttgcagttgagacaagaggaaggcatctgtctcctgcctgtccctaggcaatggaatgtctcagtataaaacctgattgtatgctccatctactgagataaggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctcttcgaggaacacccacaggtgtggaggggcaacccacccctacatctggcgcccaacgtggggcttttctctagggtgaaggtacgctcgagcgtggtcattgaggacaagtcgacgagagatcccaagtacgtctacagtcagccttacggtaagcttgtgtgctcagaagaagctaaggtgataatggggcaaactaaaagtaaaattaaaagtaaatatgcctctcatctcagctttattaaaattcttttaaaaagagggggagttaaagtatctacaaaaaatctaatcaagctatttcaaataatagaacaattttgcccatggtttccagaacaaggaactttagatctaaaagattggaaaagaattggtaaggaactaaaacaagcaggtaggaagggtaatatcattccacttacagtatggaatgattgggccattattaaagcagctttagaaccatttcaaacagaagaagatagcgtttcagtttctgatgcccctggaagctgtttaatagattgtaatgaaaagacaaggaaaaaatcccagaaagaaacggaaagtttacattgcgaatatgtagcagagccggtaatggctcagtcaacgcaaaatgttgactataatcaattacaagaggtgatataacctgaaacgttaaaattagaaggaaaaggtccagaattagtggggccatcagagtctaaaccatgaggcacaagtcctcttccagcaggtcaggtgcctgtaacattacaacctcaaatgcaggttaaagaaaataagacccaaccgccagaagcttatcaatactggccgccggctgaacttcagtatcggccacccccagaaagtcagtatggatatccaggaatgcccccagcaccacagggcagggcgccataccctcagctgcccactaggagacttaatcctatggcaccacctagtagacagggtagtgaattacatgaaattattgataaatcaagaaaggaaggagatactgaggcgtggcaattcccagtaacattagaaccgatgccaactggagaaggagcccaagagggagagcctcccacagttgaggccagatacaagtctttttcgataaaaatgctaaaagatatgaaagagggagtaaaacagtatggacccaactccccttatatgaggacattattagattccattgctcatggacatagactcattccttatgattgggagattctggcaaaatcgtctctctcaccctctcaatttttacaatttaagacttggtggattgatagagtacaagaacaggtccgaagaaatagggctgccaatcctccagttaacatagatgcagatcaactattaggaacaggtcaaaattggagtactattagtcaacaagcattaatgcaaaatgaggccattgagcaagttagagctatctgccttagagcctaggaaaaaatccaagacccaggaagcgcctgcccctcatttaatacagtaagacaaggttcgaaagagccctaccctgattttgtggcaaggctccaagatgttgctcaaaagtcaattgccgatgaaaaagcccgtaaggtcatagtggagttgatggcatatgaaaacgccaatcctaagtgtcaatcagccattaagccattaaaaggaaaggttcctacaggatcagatgtaatctcagaatatgtaaaagcctgtgatggaatcggaggagatatgcataaagctatgcttatggctcaagcaataacaggagttgttttaggaggacaagttagaacatttagaagaaaatgttataattgtggtcaaattggtcacttaaaaaagaattgcccagtcttaaacaaacagaatataactattcaagcaactacaacaggtagagagccacctgacttatgtccaagatgtaaaaaaggaaaacattgggctagtcaatgtcattctaaatttgataaaaataggcaaccattgtcaggaaacgagcaaagaggccagcctcaggccccacaacaaactggggcattcccaattcagccatttgttcctcaaagttttcagggacaacaaccccccctgtcccaagtgtttcaaggaataagccagttaccacaatacaacaattgtcccccgccacaagcagcagtgcagcagtagatttatgtactatacaagcagtctctctgcttccaagggagtccccacaaaaaatccccacaggggtatatggcccactgcctgaggggactgtaggactaatcttaggaagatcaagtctaaatctaaaaggagttcaaattcatattagtgtagttgattcagactataaaggcgaaattcaattggttattagctcttcaattccttgaggtgccagtccaggagacaggattgctcaattattactcctgccatatattaagggtggaaatagtgaaataaaaagaataggagggtttagaagcactgatccaacaggaaaggctgcatattaggcaagtcaggtctcagagaacagacctgtgtgtaaggccattattcaaggaaaacagtttgaaaggttagtagacactggagcagatgtctccatcattgctttaaatcagtggccaaaaaattggcctaaacaaaaggctgttacaggacttgttggcataggcacagcctcagaagtgtatcaaagtactgagattttacattgcttagggccagataatcaagaaagtactgttcagccaatgattacttcaattcctcttaatctgtgaggttgagatttattacaacaatggggtgcagaaatcaccatgcccgctccattatatagccccacgagtcaaaaaatcatgaccaagataggatatataccaggaaaaggactaaggaaaaatgaagatggcattaaagttccagttgaggctaaaataaatcaaaaaagagaaggaatagggtatcctttttaggggcggccactgtagagcctcctaaacccataccattaacttggaaaacagaaaaattggtgtaggtaaatcagtggccgctaccaaaacaaaaactggaggctttacatttattagcaaatgaacagttagaaaaaggtcatattgagccttcattcttgccttagaattctcctgtgtttgtaattcagaagaaatcaggcaaatggcgtatgttaactgacttaaaggccataaatgccgtaattcaacccatgaggcctctccaacctaggttgccctctccggccatgatcccaaaagactggcctttaattataattgatctaaaggattgcttttttaccatccctctggtggagcaagattgtgaaaaatttgcctttactataccagccataaataataaagaaccagccaccaggtttcagtggaaagtgttacctcaaggaatgcttaatagtccaactatttgtcagacttttgtaggtcgagctcttcaaccagttaaagaaaagttttcagactgttatattattcattatattgatgatattttatgtgctgcagaaacgaaagataaattaattgactgttatacatttctgcaagcagaagttgccaatgcaggtctggcaatagcatctgataagatccaaacctctactccttttcattatttaagaatgcagatagaaaatagaaaaattaagccacaaaaaatagaaataagaaaagacacattaaaaacactaaatgattttcaaaaattgctaggagatattaattagattcggccaactctaggcattcctacttatgccatgtcaaatttgttctctatcttaagaggagactcagacttaaatagtaaaagaatgttaaccccagaggcaacaaaagaaattaaattagtggaagaaaaaattcagtcagcgcaaataaatagaatagatcccttagccccactccatcttttaatttttgccactgcacattctccaacaggcatcattattcaaaatactgatcttgtggagtggtcattccttcctcacagtacagttaagacttttacattgtacttggatcaaatagctacattaattggtcagacaagattatgaataataaaattatgtggaaatgacccagacaaaatagttgtccctttaaccaaggaacaagttagacaagcctttatcaattctggtgcatggcagattggtcttgctaattttgtaggaattattgataatcattacccaaaaacaaaaatcttccagttcttaaaattgactacttggattctacctaaaattaccagatgtgaacctttagaaaatgctctaacagtatttactgatggttccagcaatggaaaagcagcttacacaaggccgaaagaacgagtaatcaaaactccatatcaaccgactcaaagagcaaagttggttgcagtcattacagtgttacaagattttgaccaacctatcaatattatatcagattctgcatatgtagtacaggttacaaaggatgttaagacagctctaattaaatatagcatggatgatcagttaaaccagctattcaatttattacaacaaattgtaagaaaaagaaatttcccattttatattactcatattcgagcacacactaatttaccaaggcctttgactaaagcaaatgaacaagctgacttactggtatcatctgcattcataaaagcacaagaacttcatgctttgactcatgtaaatgcagcaggattaaaaaacaaatttgatgtcacatagaaacaggcaaaagatattgtacaacattgcacccagtgtcaaatcttacacctgcccacccaagaggcaggagttaatcccagaagtctgtgtcctaatgcattatggcaaatggatgtcacgcatgttccttcatttggaagattatcatatgttcatgtaacagttgatacttattcacatttcatataggcaacttgccaaacaggagaaaatacttcccatgttaaaaaacatttattgtcttattttgctgtaataggagttccagaaaaaatcaaaactgacaatggacaaagatattgtagtaaagctttccaaaagttcttaagtcagtggaaaatttcacatacaacaagaattccttataattcccaaggacaggccatagttgaaagaactaatagaacactcaaaactcaattagttaaacaaaaagaagggggagacagtaaggagtgtaccactcctcagatgcaacttaatctagcactctatactttacattttttaaacatttatagaaattagactactacttctgcagaacaacatcttactgctaaaaagaacagcccacatgaaggaaaactaatttggtggaaagataataaaaataagacatgggaaataaggaaggtgataatgtgggggagaggttttgcttgtgtttcaccaggagaaaatcagcttcctgtttggatacccactagacatttgaagttctacaatgaactcatcagagatgcaaagaaaagcacatccgtggagacggagacaccacaatcgagcaccgttgactcacaagatgaacaaaatggtgacgtcagaagaagagatgaagttgccatccaccaagaaggcagagccaccgacttgggcacaactaaagaagctgacacagttagctacaaaatatctagagaacacaaaggtgacacaaaccccagagagtatgctgcttgcagccttgatgattgtatcaatggtggtaagtctccctatgcctgcaggagcagctgcagctaactatacctactgggcctaagtgcctttcccgcccttaatttgggcagtcacatggatggataatcctatagaagtatatgttaatgatagtgtatgggtacctggccccacagatgatcgctgccctgccaaacctgaggaagaaaggatgatgataaatatttccattgggtatcgttatcctcctatttgcctagggagagcaccaggatgtttaatgcctgcagtccaaaattggttagtagaagtacctactgtcagtcccatcagtagattcacttatcacatggtaagcgggatgtcactcaggccacaggtaaattatttacaagacttttcttatcaaagatcattaaaatttagacctaaaaggaaaccttgcctcaaggaaattcccaaagaatcaaaaaatacagaagttttagtttaggaagaatgtgtggccaatagtgcggtgatattacaaaacaatgaattcggaactattatagattaggcacctcgaggtcaattctaccacaattgctcaggacaaactcagccgtgtccaagtgcacaagtgagtccagctgttgatagcgacttaacagaaagtttagacaaacataagcataaaaaattgcagtctttctacccttaggaatgaggagaaaaaggaatctctaccccaagaccaaaaataataagtcctgtttctggtcctgaacatccagaattatggaggcttactgtggcctcacaccacattagaatttggtctggaaatcaaactttagaaacaagagatcataagccattttatactatcgacctaaattccagtctaacacttcctttacaaagttgcgtaaagcccccttatatgctagttgtaggaaatatagttattaaaccagactcccagactataacctgtgaaaattgtagattgcttacttgcattgattcaacttttaattggcaacaccgtattctgctagtgagagcaagagagggcgtgtggatccctgtgtccatggaccgaccgtaggaggcctcgccatgcgtctatattttgactgaagtattaaaaggtgttttaaatagatccaaaagattcatttttactttaattgcagtgattataggattaattgcagtcacagctacggctgctgtagcagaagttgcattgcactcttctgttcagtcagtaaactttgttaatgattggcaaaaaaattctacaagattgtggaattcacaatctagtattgatcaaaaattggcaaatcaaattaatgatcttaaaaaaactgtcatttggataggagacagactcatgagcttagaacatcgtttcacgttacaatgtgactggaatacgtcagatttttgtattacaccccaaatttataatgagtctgagcatcactaggacatagttagacgccatctacaaggaagagaagataatctcactttagacatttccaaattaaaagaacaaatttttgaagcatcaaaagcccatttaaatttagtgccaggaactgaggcaattgcaggagttgctgatggcctcgcaaatcttaaccctgtcacttaagaccatcggaagtactacaattataaatctcatattaatccttgtgtgcctgttttgtctgttgttagtctgcagctgtacccaacagctccgaagagacagcgaccatcgagaacaggccatgatgacgatagtggttttgtcgaaaagaaaagggggaaatgtggggaaaagcaagagagatcagattgttactgtgtctgtgtagaaagaagtagacataggagactccattttgttatgtactaagaaaaattcttctgccttgagattctgtgaccttacctccaatcccgtgctctctgaaacatgtgctgtgtcaactcagagttgaatggattaagggcggtgcaagatgtgctttgttaaacagatgcttgaaggcagcatgctccttaagagtcatcaccactccctaatctcaagtacccaagcacacaaaaactgcggaaggccgcagggacctctgcctaggaaagccaggtattgtccaaggtttctccccatgtgatagtctgaaatatggcctcgtaggaaaggaaagacctgactgtcccccagcccgacacccgtaaagggtctgtgctgaggaggattagtaaaagaggaaagaatgcctcttgcagttgagacaagaggaaggcatctgtctcctgcctgtccctaggcaatggaatgtctcagtataaaacccgattgtatgctccatctactgagataaggaaaaaccgccttaaggctggaagtaggacctgcaggcagcaatactgctttgtaaagcattaagatgtttatgtgtatgcatatctaaaagcacagcacttaaccctttacattgtctatgatgcaaagacctttgttcacgtgtttgtctgctgaccctctccccacaattgtcttgtgaccctgacacatccccctcttcgaggaacacccacaggtgtggaaaggcaacccacccctaca

SEQ ID NO: 518 - DNA, 2771 bp, Homo sapiens
tgggtcaggtacaaataagcccaccccactaggaactatgttaaaaaaaaattcaagaaagaatttaagggagattacagtgttactgtgacaccaggaaaacttagaactttgtgtgaaatagactggccagcattagaggtgggttggccatcagaaggaagcctggacaggtcccttgtttcaaaggtatgacacaaggtaacccgtaagccaaggcacccagaccagtttccatacatagaaagttacagctgcttttatacccccttgccccgccaacgtagttaagagaacagcagcataagcggctggcagaggcaaggaaagaccagtagagagaaaaaaaggccatctataccaattctaagttaatttagactaaacaaggtcttaatagcaaaggataattgaaatcccaaacttacaaggttttcaacaaaagtgaagtttgcttaaagttaacagtgtaacatgtattatggtaacttctaatcttgtggccttagacagtctagtccaaaggcataaagaaagtttgctttaaaaaaaaaaaaaaggaatggttatcttcaaaaaaaaaaaaagtggggggagacagaatttatgtaaaaagagtgttatatggtaaattcttgtcctgaaataaactaactggtgtttaaagaaaaaaaatgtttgtaataagtcagaaagttgagacacattgaagaattgtcggcaaaagtcgtgaaagaaaaaatgttataaaaaaatttatgcaaaaaatgttgtataatttaaaagtaataaggcctcctgagtactattaaaaaaacagtttatgtgcaaggtgtataagaaaagtaaaacatacctttggtaaaaagattataaaggggcataagaatgtggatttttacctacattaaaaggttaaaaacaattattgttttaaaagtttaagcaagttttaaaacgttaattataaagaaaattctgtgtgtaaacatattagctaaagttaaaaaggtatcatccagtttttctgtgaactggacattaaagtaaaaaatgccacaggtttttcttaaagcatcaacctgctctttaacaaaaattataaaaggttaaaaagagtctataaaatcttaccttatggtcaaacatgaaaaattggataaatatgtctacaaggttttattaaaattcagtttaaaattaataacacactaatataaaggtaaaatttagcttatctggtataaaaatcatacaagaaacattattaaatataaaatggtgtttagctttctttggtctaaaaactaataaaaattggtgctaaaggaaacattcattttactagaggatcataaaagttaaagacttaaaacaaactttggcaattaagacagcacgccaagatgcaagtgcctggctgaaatggatcaaatattccatctgcactttaaacaaatgcaattgttatgcttgtgcacatggcaggccagaggccctgattgtcccccttccactaaggtggtcctccagttgaccaggcatgggctgcagggtagctattttccaggtttctacagcttggagtaataagtcatgccaagctctctctgctatatcccaaagtccctgcgggtcagcccctgagggccgtccagcttccgtctcccaacactaagttcacttcatgtctctcatggcagggaggagacttagcattccttggagacctgaagggatgcagtgagcttaagaattttcaagagcttatcagtcagtcagcccttgttcatccccgagcggatgtgtgatggtattgtcgtggacctttattgggcactctgccgaataactagagtggcacttgtgctttagcctatttggctatccctttcaccctggcatttcatcaaccagaggaaggaaaaaaaaaataataagacatcgtaaagcgagagaagccccttatgggtctttcaactctcacatctatttagatgcaatcgaagccccgcaaggaacaccagatcaatttaaagtccgaaatcaaatagctacaggatttaagtcaatattttggtagatgacagtcaataaaaatgtagattagataaactgcatctattacacccaacagcaatgagcttttcatgagttgaaaaaaagaaaaaacccatgtcggccccagccctggggctacctgacctgacaaaaccttttacactctatgtgtcagaaagagaaaaagtggcagttggagttttaacccagactgtagggccctggccaaggccagtggcctatctctcaaaacaactagatgaggtttccaaacgctggcccccatgtccaaagtccctggtagcaatagccctgttagcacaagaagcagataagctaactcttagacaaaacctaaacataaagtccccctatgctgtggtgattttaataaataccaaaggacaccattagctaatgaatgctagactagctagataccaaagcttgctctgtgaacatccccgcataaccattgaagtttgcaacacctaaaccccgccaccttcctcccggtgtcagagagcccagttaaacataactgtgtagaggtattggactcagtttattctagtgggcctaaccaccgagaccatccttaaacatcagtagactgggagctgtacatggatgggagcagcttcaccaacccctgcaaagtgactctgaagaagacgacaagccctgctccagtcacacccggaagctga

SEQ ID NO: 519 - DNA, 5995 bp, Homo sapiens
ataataatattgttaaaatggtctgttcctaacttaactgatgatattatcttgtggaattccttctcctggctcatcctggctcaaaaactcccctactgagcaccttgtgaccctcattcctgcccgccagagaacaaccccccttttttcctttacctacccaaatcctataaaacggcccacccctatctcccttcgctggctctcttttcggactcagcccacctgcacccaggtgaaataaacagccttgttgctcacacaaagcctgtttggtggtctcttcacacagacacacatgaaatttggtgccatgactcggatcgggggacctcccttgggatatcaatcccctgtccccccttgagaaagatccacctatgaccttgggtcctcagaccgaccagcccaaggaacatctcaccaatttcaaatacagtaagcggcctgtttttactttcttctccaacctctctcacgatccctcaacctctttctcctttcaatcttggtgccacacttcaatctcccttctcttaatttcaattcctttcattttctggtagagacaaaggagacacattttatccgtggacccaaaactccagcaccggtcacggactcaggaaggcagccttcccttggtgtttaatcattgcaaggacagctctctgattattcacccacgttccactggtgtctgatctctgcggggacacctgccttgatcattcacccacattcccttggtggcgagtcaattgcggggacacctgccttgatcattcacccacattcccttggtggcaagtcaattgcggggacgcctgccttgatcattcacccacattcccttggtggcgagtcaattgcggggacgcctgctttggctgctcgcccacattgcagcccagggctgttccccacccccttctccgtgtctctacccttctctttaaacttgcctccttcactataggcaaccttccaccctccattcctccttcttctcccttagcctgtgttcttaagaacttaaaacctcttcaactctcgcctgacctaaaatctaagcatcttattttcttctgcaacaccgcttggccccaatagaaacttgacaatggctccaaatagccagaaaacagcacttttgatttttccatcctacaagatcgagatgattcttgtcataaaatgggcaaatggtctgaggtgcctgacgtccaggcattcttttacacactgttccctcccttctctctgttcccaatgcgactcgtcccaaatcctccttctttccctcccgcctgtcctctcagtcccaaccccaagcatcgctgagtctttctaatcttccttttctacagacccatctgacctctcccctcttccccaggctgctcctcgccaggccgagccaggtctcaattcttcctcggcctctgctcccacaccctataatccttttatcacctcccctcctcacacccggtctggcttacagtttcattctgtgactagcccgccccaaccttcccagcaatttcctcttaaaaaggtggctggagctaaaggcacagtcaaggttaatgctcctttttctttatccgacctctctcaaatcagttagcattcaggctttttcatcaaatatgaaaaatccagcccagttcatggctcgttcggcagcaaccctgagacgctttacagccctagaccctaaaaggtcaaaaggccgtcttattctcaatatacattttattacccaatccgctcctgacattaaataaaactccaaaaattaaattccagccctcaaaccccacaacaggacttaattaacctcgcctttaaggtgtacaataataaagtagaggcagccaagtagcaacatatttctgagttgcaattccttgcctccactgtgagacaaaccccagccacatctccagcacacaagaacttccaaacacctaaaccgcagtggccagagtttccttcagaacctcctcccccaggagcttgctacaagtgccggaaatctggccactaggccaaggaatgcccacagcccgggattcctcctaagccgtgtcccatctgtgcaggacccaactgaaaatcggactgttcaactcacctggcagccactctcagggcccctagaactctggcccaaggctctctgactccttcccagatcttctcagcttagcagctgaagactgacactgccagatcgcctcaaaagcctacaggaccatcacagacgctctgggtaactctcacagtggagggtaagtctgtccccttcttaatcaatacagaggcaacccactccacattaccttcttttcaaaggcttgtttcccttgcctccgtaactattgcaggtactgacggccaggcttctaaacctcttaaaactcctcaactctggtgccaacttagacaatactcttttaagcactcctttttagttatccccacctgccctgttcccttattaggccgagacactttaactaaatttaaattatctgcttccctgactattcctgggctacagccacacctcattgctgccttttcccccagttcaaagcctccttcacatcctccccttgtatctccccaccttagcccacaagtataggacacctctactccctccttggcgaccgatcatgcaccccttaccatcccattaaaacctaatcacccttatcccgctcaatgccaatatcccatcccttagcacgctttaaaaggattaaagtcttatcaatcgcctgctacagcatggccttttaaagcctataaactccccttacaattcccccattttacctgtcctaaaaccaggcaaggcttacaggttagttcaggatctgcgtcttatcaaccaaattgttttgcctatccaccccgtggtgccaaacccatatactctcctatgctcaatacctccctccacaacccattattctgttctggatctcaaacatgctttctttactattcctttgcacccttcatcccagcctctcttcactttcacttggactgaccctgacacccatcaggctcagcaaatcacctgtgctgtactgccgcaaagcttcacagatagcccccattacttcagtcaagcccaaatttcttcctcatctgttacctatctcggcataattctcataaaaacacacgtgctctccctgccgatcgtgtccgactgatctcttaaaccccagcaccttctacaaaacaactcctttccttcctaggcatggttggatacttttgactttagatacctggttttgccatcctaacaaaaccattatgtaaactcacaaaaggaaacctagctgaccccatagatcctaaatcctttccccactcctttctgttccctgaagacaactttagagactgcccctaccctagatctccctgaatgatcccaacccttttcattacccacagctggagtgcagggctgtgcagtcagaattcttacacaagaaccgggaccgcgccctgtagcctttttatccaaacaatttgaccttactgttttgcctagccctcaagtctgcgtgctgcggccgccaccgccctaatacttttagaggcccttaaaatcacaaactatgctcaactcactctctacagttctcataacttccaaaatctattttcttcctcccacctgacacatatactttctgctccccggctccttcagctgtactcactctttgttgagtctcccacaattaccattgttcctggcccagatttaatccggcctcccacattattcctgataccacacctgacccccatgactgtatctctctgatccacctgacattcaccccatttccccatatttccttctttcctgttcctcaccctgatcacacttggtttattgatggcagttccatcaggcctaatcgccacacaccagcaaaggcaggctgtgctatagtacaagccactagcctgcctcttagaacctctcatttcctttccatcgtggaaatctatcctcaaggaaatcacttctcagtgttccgtctgctattctacaacttctcagggattattcaggccccctcccttccctacacatcaagcttagagatttgcccccacccaggactggcaaattgactttgctcaacatgccctgagtcaggaaactaaaatacctcttggtctaggtagacactttcactggataggtagaggcctttcccacagggtctaagaagaccaccacggtcatttcttcccttctgtcagatataattccttggtttggccttcccacctctatacagtccgatagcagactggcctttattagtcaaatcagccaagcattttttttcaggctcttggtattcagtgaaacctttataatccttacagtcctcagtcttcaggaaaggtagaatggactaatggtcttttaaaaacacacctcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaacacacctcaccaagctcagccaccaacttaaaaaggactggacaatacttttaccactttcccctctcagaattcaggcctgtcctcagaatgctacaaggtacagcccatttaagttcctgtatagacgctcctttttattaggccccagtctcattccagacaccagaccaacttggactgtgccccaaaaaacttgtcatccctactatctcctgtctagtcatactcctattcaccgttctcaactactcatacatgccctgctcttgtttacactgtttctccaagccatcacagctgatatctcctggtgctatccccaaactgccagtcttaactcttaaagtaaataaataatctttgctggcaggactatgctgaatctccttaggcactctctaattagatgtcttaggtcctcccaattcttagacctttaatacttgtctttctccttctcttattccatttagcttttcaattcatacaaaaccatatccagaccatcaccaataattctaaatgacaaatgtttcttctaacaaccccacaatatcatcccttaccacaaaatcttccttcagcttaatctctcccgctttaggttcctacacctcccctaatcccgctcaaagcagccctgagaaacatcgcccattgtctctccataacacccccaaaaattttcaccgtcccaacattctaccactatttcattttatttttcttattaatatatgaagacaggaatgtcaggcctctgagcccaagctaagccatcatatcccatgacctgcacgtacacatccagatggccggttcctgccttaactgatgacattccaccacaaaagaagtgaaaatggcctgttcctgccttaactgatgacattatcttgtgaaattccttctcctggctcatcctggctcaaaagctcccctactgagcaccttgtgacccccactcctgcccgccagagaacaaccccccttttttcctttacctacccaaatcctttaaaacggccccacccctatctcccttcgctggctgactctcttttcagactcagcccacctgcacccaggtgaaataaacagccctgttgctcacacaaagcctgtttggtatggtggtctcttcacacggacgcacatgaaa

SEQ ID NO: 520 - DNA, 969 bp, Homo sapiens
gaattgtggggaaaagagagagatcagactgttactgtgtctatgtagaaagaagtagacataagagactacattttgttctgtactaagaaaaattcttctgccttgagatgctgtgaatctgtaaccctagccccaaccctgtgctggcagaaacatgtgctgtgtcaactcaaggttaaatggattaagggctgttcaggatgtgctttgttaaacaaatgctagaagacagcgtgcttgttaaaagtcatcaccactccttactctcaagtacccagggacacagaacactgcgaaaggccgcaggaacctctgcctaggaaagccaggtattgtccaaagtttctcccatgtgatagcctgagatatggcctcatgggaagggaaagacctgaccatcccccagcccaacacccgtaaagggtctgtgctgaggaggattagtaaaagaggaaggcctctttgcagttgaggtaagaggaaggcatctgtctcctgctggtccctggacaatggaatgtctcggtgtaaagcccaattgtatattccatctactgagataggagaaaactgccttagagctggaggtgagacatgctggaggcagtactgctctttaaggcattgagatgtttatgtatatgcacatcaaaagcacagcactttttcctttaccttgtttatgacagagacatttgttcaggttttcctgctgaccctctctccactattaccttattgtcctgccacatccccctctccgagatggtagagataatgatcaataaatactgagggaactcagaggccggtgcaggcgcgggtcctctgtatgctgagtgctggtcctgtaggcctacttttctttctctgtactttgtctctatgtctctttcttttctcaaatctctccgttccacctgacgagaaatgcccacaggtgtggaggggcaggccaccccttca

SEQ ID NO: 521 - DNA, 5575 bp, Homo sapiens
gtcagacctctgagcccaagctaagccatcgcatcccctgtgacttgcacgtatacatccagatggcctgaagtaactgaagatccacaaaagaagtaaaaatagccttaactgatgacattccaccattgtgatttgttcctgccccaccctaactgatcaatgtactttgtaatctcccccacccttaagaaggttctttttaattctccccacccttgagaatgtactttgtgagctccacccactgtctgcaaaacattgctcttaacttcagcgcctatcccaaaacctataagaactgatgataatccaccaccctttgctgactctcttttcggactcagcccgcctgcacccaggtgaaataaacagccatgttactcacacaaagcctgtttggtggtctcttcacacggacgtgcatgaaatttggtgccgtgactcggatcgggggacctcccttgggagatcaatcccccgtcctcctgctctttgctctgtgagaaagatccacctacgacctcaggtcctcagactgaccagcccaagaaacatctcaccaatttgaaatccggtaagcagcctctttttactctcttctgcaacctccctcactatccctcaacctctttctcctttcaatcttggcaccacatttcaatctctcccttctcttaatttcaattcctttcattttctggtagagacaaaggggacacgttttatccgtggacccaaaactccggcgccggtcacggactgggaaggcagccttcccttggtgtttaatcattgcaaggatgcctctctgattattcacccacgtttcaagggtgtcagaccacacagggacgcctgccttggtccttcacccttagcggcaagtcccgcttttctggggaaggggcaagtaccccaaccccttctctccttgtctctatcccttctctgcttttctggggaaggggcaagtaccccaaccccttctctccgtgtctctaccccttctctccgtgtctctaccccttctctgcctttctgggggaggggcaagtacccctcaaccccttcttcacccttagcggcaagtcccgcttttctagggggcaagaacccccaattccttatttccacaccccgacctcttatctctgtgccccaattccttatttctgcaccctgacctcttatctctgtgccccaatcccttatttctgcaccccgacctctcaactctgtgccccaatcccttatttctgcaccccaacctcttatctctgtgccccaatcccttatttccgtgccctgaccccccttcccgcttttctggagggtaagaacccccgaaacccttccctccatgtctctacattctcttttctctaggtttgcctccttcactatgggcaaccttccaccctccattcctccttcttctcccttagcctgtgttctcaagaacttaaaacctcttcaactcacacctgacctaaaacctaaatgccttattttcttctgcaatgccgcttgaccccaatacaaactcgacagtagctccaaatagccagaaaacggcactttgaatttttccatcctgcaagatctaaataattcttgtcgtaaaataggcaaacggtctgagttgcctgacgtccaggcattcttttacacatcagtcccttcctagtctttgtccccaatgcaactcgtcccaaatcttccttctttcccttccgcctgtcccctcagtcccaaccccaagcgtcgctgagtctttctaatcttccttttctacagacccatctgacctttcccctcctccccaggctgctcctcgccaggccgagctaggtcccaattcttcctcagcctctgctcctccaccctataatccttttatcacctcgcctcctcacacctggtccagcttacagtttcgttccgtgactagccctcccccacctgcccagcaatttactcttaaaaaggtggctgaagctaaaggcatagtcaaggttaatgctcctttttctttatcccaaatcagaagcatttaggctctttttcatcaaatataaaaacccagcccagttcatggctcgtttggcagcaaccctgagacgctttacagccctagaccctaaaaggtcaaaaggccgtcttattctcaatatacattttactacccaatctgctcccgacattaaataaaactccaaaaattggaatctggccctcaaaccccacaacaggacttaattaacctcaccttcaaggtgtacaataacagaaaaaagttgcaattccttgcctccactgtgagacaaaccccagccacatctccagcacacaagaacgtccaaacgcctgaaccacagcagccaggggttcctccagaacctcctcccccaggagcttgctacacgtgccggaaatctggccactgggccaaggaatgcccgcagcccgggattcctcctaagctgcgtcccatctgtgtgggaccccactgaaaatccgactgttcaactcacctggcagccactcccagagcccctggaactctggcccaaggctctctgactgactccttcccagatcttctcggcttagcagctgaagactgacactgcccgattgcctcggaagccccctaaaccatcacggatgccgagcttcaggtaactctcacggtagaaggtagtaagcgcgtccccttcttaatcaatacggaggctacccactccacattaccttcttttcaaaggcctgtttcccttgcctccataactgttgtaagtattgacggccaggcttctaaacctcttaaaactccccaactctggtgccaacttagacaatactcttttaagcactcctttttagttatccccacctgcccagttcccttattaggctgagacactttaactaaattatctgcttccctgactattcctggactacagccacatctcattgccgcccttcttcccaatccaaagcctcctttgcgtcctcctcttgtatccccctaccttaacccacaagtataagatacctctactccctccttggtgaccgatcatgtaccccttaccgtctcattaaaacctaatcacccttaccccactcaatgtcaagatcccatcccacagcacgctttaaaaggattaaagcctgttatcactcgcctgctacagcatggccttttaaagcctatgaactcttcttaccattcccccattttacctgtcctaaaaccagacaagccttacaagttagttcagaatctgcgccttatcaaccaaattgttctgcctatccacccggtggtgccaaacccatactcgatacctccctctactacccattattctgttctagatctcaaacatgctttctttactattcctttgcacccttcatcccagcctctctttgctttcacttagactgaccctgacacccattaggctcagcaaattacctcggctgtactgccgcaaggcttcacagacagcccccattacttcagtcaagcccaaatttcatcctcatctgttacctatctcagcataattctcataaaaatacacgtgctctccctgctgatcgtgtctgattaatctcccaaacctcagtcccttacaaaataacaactcctttccttcctaggcatggttagtgcagtcagaattcctacacaagagccaggacaggactgcaccctgtagcctttctgtccaaacaacttgaccttactgttttagcctagccctcatgtctgtgtgcagcggctgccgctgctttaatactgttagaggccctaaaaatcgcaaactatgctcaactcactctctacatttctcataacttccaaaatctattttcttcctcatacctgacgcatatactttctgctccccagctccttcagctgtactcactctttgttaagtcccacaattaccattgttcctggcccggacttcaatctggcctcccacattattcctgataccacacctgacccccatgactgtatctctctgatccacctgatattcaccccatttccccatatttccttctttcctattcctcaccctgatcacgcttgatttattgatggcagttccaccaggcctaatcgccacacaccagcaaaggcaggctatgctatagtacaagtcactagcccgcctctcagaacctctcatttcctttccatcgtggaaatctatcctcaaggaaataacttctcagtgttccatctgctattctactactcctcagggattattcaggccccctcccttccctacacatcaagctcaaggatttgcccccacccaggactggcaaattagctttactcaacatgtcccgagtcaggaaactaaaatacctcttagtctaaatagacactttcactgaataagtaaaggcctttcctacagggtctgagaaggccaccacagtcatttcttcccttctgtcagacataattcctcagtttagccttcccacctcaatacagtctaataacagaccatcctttactagtcaaatcagccaagcagcttttcaggctcttagtattcagtgaaacctttatatcccttacggtcctccatcttcaagaaaaggagaacggactaaaggtcttttaaaaacacacctcaccaagctcagccaccaacttaaaaaggactggacaatactttcaccactttcgtttctcagaattcaggcctgtcctcagaatgctacaaggtacagcccatttaagctcctgtatagacgctcctttttattaggccccagtcccattcgacaccagaccaacttagactgtgccccaaaaaaacttgtcatccctactatcttttgtctagtcatactcctattcaccattctcaactactcatacatgccctgctcttgtttacactgctggtttatactgtttctccaagccatcacagctgatatctcctggtgctatccccaaactgccactctaaactcttgaagtaaataaataatctttgccggcaggactatgctgaatctccttaggcactctctaatcagatgtcctaggtcctcccaattcttagaccttttatacctgtttttctccttctcttattccatttagtttctcaattcatccaaaaccatatgcagtccatcaccaatcattctatacgacaaatgtttcttctaacatccccacaatatcaccccttaccacaagacctcccttcagcttaatctctcccactctaggttcccacgccgcccctaatcccgcttgaagcagccctgagaaacatcgcccattctctctccattccaccccccaaaaattttcgccgccccaacacttcaacactattttgttttatttttcttattataagaaggcaggaatgtcaggcctctgagcccaagccaagccatcgcatcccctgtgacttgcacgtatacatccagatggcctgaagtaactgaagatccacaaaagaaataaaaatagccttaactgatgacattccatcat

SEQ ID NO: 522 - DNA, 846 bp, Homo sapiens
agcagctcattgagaacgggccaggatgacaatggcggctttgtggaatagagaggggagaaaggtggggaaaagattgagaaatcggatggttgccgtgtctgtgtagaaggaggtagacatgggagacttttcattttgttctgtactaagagaagttcttctgccttgggatcctgttgatctgtgaccttacccccaaccctgtgctctctgaaacatgtgctgtgtcaaactcagggttaaatggattaagggcggtgcaagatgtgctttgttaaacagatgcttgaaggcagcatgctccttaagcgtcatcaccactccctaatctcaagtacccagggacacaaacactgcagaaggccacagggacctctgcctaggaaagccaggtattgtccaaggtttctccccatgtgatagtctgaaatatggcctcttgggaagggaaagacctgaccgtcccccagcccgacacctgtaaagggtctgtgctgaggaggattagtataagaggaaggcatgcctcttgcagttgagacaagagcaaggcaactgtctcctgtccgtccctgggcaatggaatgtctcggtataaaacccgattgtacgttccatctactgagatggggaaaaaccgcctatctcacctatcaccgcctatcaccactccccaatctcaagtacccagggacacaaacgctgcggaaggccgcagggtcctctgcctaggaaaaccagagacctttgttcacttgtttatctgctgaccttccctccactattgtcctatgaccctgccaaatccccctctgtgagaaacacccaagaatgatcaataaa

SEQ ID NO: 523 - DNA, 2113 bp, Homo sapiens
tgcagtcagaattcttacacaagagccaggatcgcaccctgtagcctttctgtccaaacaacttgtccttactgttttagcctagctatcatatctctgtgcagcagctgctgccgccctaatacttttagaggccctcaaaatcacaaactatgctcaactcactctctacatttctcataactgccaaaatctgttttcttcctcgcacctgacgcatatactttctgctccccggctccttcagctgtactcactctttgttaagtcccacaattaccattgttcctggcctggacttcaatccggcctcccacattatccctgataccacacctgactcccatgactgtatctctctgatccacctgacactcaccccatttccccatatttccttctttcccgttcctcaccctgatcacgcttgatttattgatggcggttccaccaggcctaatcgccacacaccagcaaaggcaggctatgctatagtacaagccactagcccgtctcttagaacctctcatttcctttccatcatggaaatctatcctcaaggaaataacttctcagtgttccatctgctattctactactcctcagggattattcaggccccctcccttccctacacatcaagctcaaggatttgcccccacccaggactggcaaattagctttactcaacatgccccgagtcagataactaaaatacctcttagtctaggtagacactttcactagataggtagaggcctttcctacagggtctgagaaggccaccgcagtcatttcttcccttctgtcagacataattcctcagtttagccttcccacctctatacagtctgataacagaccagcctttattagtcaaatcagccaagcagtttttcaggctcttagtattcagtgaaacctttatatcccttacggtcctccgtcttcaggaaaagtagaacggactaaaggtcttttaaaaacacacctcaccaagctcagccaccaacttaaaaaggcctggacaatacttttaccactttcccttctcagaattcaggcctgtcctcggaatgctacaaggtacggcccatttgagctcctatatagatgctcctttttattaggccccagtctcattccagacaccagaccaacttagactgtgccccaaaaaacttgtcatccctactatcttctgtctagtcatactcctattcaccgttctcaactactcatacatgccctgctcttgtttacactgcgggtttacactgtttctccaagccatcacagctgatatctcctggtgctatccccaaactgccactcttaactcttgaagtaaataaataatctttgctggcaggactatgctgaatctccttaggcactctctaattagatgtcctaggtcatcccaattcttagaccttttatatctgtttttctccttctcttattccatttagtttttcaattcatataaaaccgtatccaggccatcaccaataattctacatgacaaatgtttcttctaacaaccccacaatatcaccccttaccacaaaatcttccttcagcttaatctctcccactctaggttcccatgccgcccctaatcccgctggaagcagccctgagaaacatcgcccattatctctccataccacgccaaaaaattttcaccgtcccaacacattaccactatttcattgtatttttcttattaatataagaagacaggaatgtcaggcctctgagcccaagctaagccatcgtatcccctgtgacctgcatgtacacatccagatggctggttcctgccttaactgatgacattgtcttgtgaatttccttctcctggctcaccccggctcaaaagctcccctactgagcaccttttgaccccactctgcccgacagagaacaacccccctttgactgtaattttcctttatctacccaaatcctataaaacggccccacccttatctcccttcactgactctctttttggactcagcccgcctgcacccaggtgaaataaacagccatgttcctcacacaaagcctgtttggtggtctcttcacatggacgtgcatgaaa

SEQ ID NO: 524 - DNA, 4218 bp, Homo sapiens
tcacatttcaatcttggcgccacacttcaatctctcccttctcttaatttcaattcctttcattttctgatagagacaaaggagacacgtggacccaaaactccgtggacccaaactccgtggacccaaaactccgtggactcaaaactccagcgccctctgggggaggggcaagtacccctcaaccccttctccttcacccttagtggcaagtcccgcttttctagggggcaagaacccccaatcccttatttccgcaccccgacctcttatctctgtgtcccaatcccttatttccgcaccccgacctcttatctctgtgccccaatcccttatttccgtgccccaaccctttctctgcttttctggagggcaagaaacccccacccccttctccgtatctctactcttttctctaggcttgcctccttcactatgggcaagcttccaccttccattcctccttcttctcccttagcctgtatccttaagaacttaaaacctcttcaactctcacctgacctaaaatcaaagtgtcttattttcttctgcaatgccgcttgaccccaatacaaactcgacagtagttccaaatagccggaaaacagctctttcaatttttccatcctacaagagctaaataattcttgtcgtaaaatgggcaaatgatctgaggtgcctgacgtccacgcattcttttacacatcagtcccttcctagtctctgtgcccagtgcaactcgtcccaaatcttccttctttccctcccgcctgtcccctcagtcccaaccccaagcgtcgctgagtctttctaatcttccttttctacagacccatctgacctctcccctcctcgccagaccaagctaggtcccatttcttcctcagcctccgctcctccaccctgtaatctttttatcgcctctcctcctcacacccggtctgacttacagtttcgttctgtgactagccctcccccacctgcccagcaatttactcttaaaaaggtggctggagctaaaggcatagtcaaggttaatgctcctttttctttatcccaaatcagatagcgtttaggctctttttcatcaaatataaaaccccagccgagttcatggctcgttcggcagcaaccctgagaagctttacagccctagaccctaaaaggtcaaaaggccatcttattctcaatatacattttattacccaatctgctcccgacattaaataaaactccaaaaattagaatctggccctcaaaccccacaacaggacttaattaacctcaccttcaaggtgtacaataataaaaaaagttgcaattccttacctccactgtgagacaaaccccagctacatctccagcacacaagaacttccaaacgcctgaactgcagcggccaggcgttcctccagaacctcctcccccaggagcttactacaagtgctagaaatctggacaccaggccaaggaatgcctgcagcccaggattcctcctaagccgtgtcccatctgcgcgggaccccactggaaatcggactgttcaactcacctggcagccactcccagagcccctggaactctggcccaaggctccctgactgactccttctcggcttagcagctgaagactgaggctgcctgattgccttggaagccccgtagaccatcgcggatgccgagctttaagtaactctcacagtggagtgtaagtccatccccttcttaatcaatacggaggctacccactccacattaccttcttttcaaaggcctgtttcccttgcctccataactgctgtgcgtattgacagccagacttctaaacctcttaaaactccccaactctggtgccaacttagacaacactcttttatgcactcttttttagttatctccacctgcccagttcccttattaggccgagatattttaaccaaattatctgcttccctgactattcctggattacagctgcatctcattgctgcccttcttcccaatccaaagcctcctttgcgtcctcctcttgtattcccccaccttaacccacaagagacctctactccctccttggcgaccaatcatgcaccccttaccatctcattaaaacctaatcacccttaccccactcaatgccaatatcccatcccacagcaagctttgaaaggattaatgcctgttatcactcgcctgctacagcatggccttttaaagcctataaactctccttacaattcccccattttacctgtcctaaaaccagacaagccttacaagttagttcaggatctatgccttatcaaccaaattgttttgcctatccaccccatggtgccaaacccatatactctcctatccgcaatacctccctccacaatccattattctgttctggatctcaaacgtgctttctttactattcctttgcacccgtcatcccagcctctcttcgcttcacttggactgaccctgacacccatcaggctcagcaaattacctgggctgtactgccacaaggcttcacagacagcccccattacttcagtcaagcccaaatttcatcctcatctgttacctatctcggcataattctcgtaaaaacacacgtgctcttcctgctgatcgtgtccgactaatctcccaaacctcaatcctttacaaaacaacaactcctttccttcctaggcatggttagtgcagtcaaaattcttacacaagagccaggaccgcacactgtagcctttctgtgcaaacaacttgaccttactgttttagcctagccctcatgtctgcgtgcagcggctgccactgctttaatacttttagaggcctttcctacaaggtctgagaaggccaccacagtcatttcttcccttctgtcagacataattcctcagtttagccttcccacctctatacagtctgataacagaccagcctttattagtcaaatcagccaagcattttttcaggctcttagtattcagtgacagactaatggtctattaaaaacacacctcaccaagctcagccaccaacttaaaaaggactggacaatacttttaccactttcccttctcagaagtcagacatgtcctcagaatgctacaaggtacagcccatttaacctcctgtatagatgctcctttttattaggccccagtctcattccagacaccagaccaacttcgactgtgccccaaaaaacttgtcatccctactatcttctgtctagtcatactcctattcaccgttctcaactactcatacatgccctgctcttgtttacactgccggtttatactgtttctccaagccatcacagctgatatctcctcgtgctatctccaaattgccactcttaactcttgaagtaaataaataatctttgctggcaggactatgctgaatctccataggcactctctaattaaatgtcctaggtcctcccaattcttagaccttttatacctgtttttctccttctcttattccatttagtttttcaattcatacaaaaccgtatccaggccatcaccaatcattctacatgacaaatgtttcttctaacaaccccacaatatcaccccttaccacaagacctcccttcagcttaatctctcccactctaggttcccacgccacccctaatcccgcttgaagcagcccggagaaacatcgtccattctgtctccataccactcccccaaaattttcaccgccccaacacttcaacactattttgttttatttttcttattaatatatgaaggcaggaatgtcaggcctctgagcccaagccaagccatcgcatcccctgtgacttgcacctatacgcccagatggcttgaagtaactgaagaatcacaaaagaagtgaaaaggccctgccccgccttaactgatgacattccaccattgtgatttgtttctgccccaccttaactgagtgattaaccctgtgaatttccttctcctggctcagaagctcccccactgagcaccttgtgaccccccttccctgcccaccagagaacaaccccctttgactgtaattttccattatcttcccaaatcctataaaacggccccacccctatctcccttcgctgactctctttttggactcagcccgcctgcacccaggtgaaataaacagccatgttgctcacacaaagcctgtttggtggttctcttcacacggatgcgcatgaaa

SEQ ID NO: 525 - DNA, 942 bp, Homo sapiens
gtggggaaaagaaagagagatcagattgttactgtgtctctgtagaaagaagtagacataggagactccattttgttctgtactaagagaaattcttctgccttgaaatgctgttaatctgtaaccccacccccaaccccctgctccctgaaacatgtgctgtgtccactcagggttaaatggattaagggcggtgcaagatgtgctttgttaaacagatgcttgaaggcagcaggctcgttaagagtcatcaccactccctaatctcaagtacccagggacacaaacactgcggaaggccgcagggtcctctgcctaggaaagccaggtattgtccaaggtttctccccatgtgatagcctgagatatggcctcagcccgacactcgtaaagggtctgtgctgaggaggattagtaaaagaggaagggacgcctctttgcagttgagacaagaggaaggcatctgtctcctgctcgtccctgggcaatggaatgtctccgtgtaaaacccgattgtatattccatctactgagataggggaaaaccgccttagggctggagatgtgacaggcgggcagcaatactgctctttaaggcattgagatgtttatgtgtatgcatatctaaagcacagcacttaattctttaccttgttcatgatgcagagacctttgttcacgtgttcacctgctgaccttctctccactattatcctatgatcctgccacatccccctctccgagaaacacccaataatgatcaatagatactaagggaactcagaggccagcgtggatcgtggatcctccgtatgctgaacaccggtcccctgggtcccctttttctttctctgtactttgtctctgtgtctctttcttttccaagtctctcgttccacctaacgagaaacacccacaggtgtggaggggcaacccacccct

SEQ ID NO: 526 - DNA, 477 bp, Homo sapiens
tcaggtggttggtaactgtctctcttaaaataataattggttgcaaccaacaccagggaaaggccgtttcccaatagatagaaagcacctggaactggtgatcagcagcttcccgataagatctcaggagctgggcgagtgggctcaagcatgtgcactaagaggcaacatggtggagtttaactggcatatgacctgggagcatttgactggtaaaggaagaatgcctcaagtgagcatgcgcacttcagtaaacacgctgcgcatgaggcccctccggagcgctggcaggccactgcgcatgcggacagaccaccccaagggaagaaccaggggaaagttaacgcaagccccggaaggatgccaacctatcaaaccccaagtccaagatcaaacagtgcacttgactctctcaagtcacctgcttgaccctcttccaagtgtactttacctcctttccttactgccctaaaactt

SEQ ID NO: 527 - DNA, 704 bp, Homo sapiens
ttacagtaggtagttagtcagatatgagcgggataggaaaggctcccaccaccactaggaatgtcacgcaattatcaggtgatggtcaggtggttattaaactgtctctctaaaataataattggccacagccagcaccaaggaaaagcggtctcccaataggtaaaaaccggaaattggtgattaacagcttcccaataaaatctcaggagttgggcaagtggactcaagaatgcagtttaagaggcaaaatggcagagtttaactggtgtattacctactatatgaccttctagggacatatgattggtaagggaagaatgcctccagtgagcatgtgtacagctccagtaaacacattgtgcatgctcacctcccaagtgcgggtgggccactgtgcatgcagacagcccaccctaagggaaaaatcaggggagaagggatgcaagaccccagaaacatgccaacatataaaacccgaagtcaaaacgtcaaacggtgcactcgatctctcaagtcacctgctaggccctcttccaagtgtgtttatccttgctttcattcctgctttaaagctttttgataaactttcatttctggtctaaagtttgccttggtctcttattctgccttttgcccctcactggaattctttcttctgaggagggaagaattgaggttgctgcaaacctgtacagatttgc

SEQ ID NO: 528 - DNA, 5417 bp, Homo sapiens
gtcaggcctctgagcccaagccaatccatcgcatcccctgtgacttgaacatatacaccagatggtctgaagtaactgaagatccacaaaagacatcaaaatagccttaactgatgacattctaccattgtgatttgttccttccccaccctatctgatcaatgtactttgtaatctcccccacccttaagatgtttctttgtaattctccccacccttgagaatgtactttgtgagatcgacccctgtccgcaaaacattgctatcaacttcaccacctatcccaaaacctataagaactaatggtaatccatctccctttgctgactctcttttcagactcagcccacctgcacccagttgaaataaacagccatgttgctcacacaaagcctgtttggtggtctcttcacatggacgggcatgaaatttggtgccgtgactcggatcgggggacctcccttaggagatcaatcccccatcctcctgctctttgctccgtgagagagatccacctatgagctcaggtcctcagactcaccagcccaagaaacatctcaccaatttcacttccggtaagcggcctctttttactctccaacttctctcactatccctccaacctctttctcctttcaatcttggcaccacacttcaatctctcccatctcttaatttcaattcctttcattttctattagatacaaaggagacacgttttatccgtggacccaaaactccggcgccggtcacggactgggaaggcaggcttcccttggtgtttaatcattgcaggcccacctctctgattattcacccatgtttcaaaggtgtcagaccatgcagggacgcctgccttggtccttcacccttagcggcaagtcccgcttttctgggggaggggcaagtaccccaaccccttctctccgtgtctctaccccttctctgctcttctggggcaggagcaagaacccctcaaccccttctccttcacccttagtggcaagtcccacttttctaggggacgggcaagtaccccaaccccttctgtgtctctaccccttctctgcttttctggggtaggggcaagtacccctcaaccccttctccttcacccttagcagcaagtcccacttttctaggtggcaagaatccccaatcccttatttccacgctacaacccctttcccacttttctggagggtgagaacccctgaaccccttccctccctctctctatgctctctttgctctgggcttgcctccctcactatgggcaaccttccaccctccattcctcctttttctcccttagcctgtattcttaagaacttataaacctctgcaactctcacctgacctaaaatctaagcgtcttattttcttctgcaatgctgcctgaccccaatacaaactccacagtagttccaaatagcccaaaaatggcactttcaatctttccaccctacaagatctaaataattcttgtcatagaatgggcaaatggtctgaggaggcctgatgtccaggcattctttcacacatcagtcccttcctagtctctgtgcccagtgcaactgctcccaaatcttctttctttccctcccacctgtcccctcagtcccaaccccaagtgtcgctgagtctttgtaatcttccttttctacagacccatctgacctctcccctcctcgccaggccgagctaggtcctaattcttcctcagcctctgctcctccatcctgtaatctttttatcgccttccctcctcacacctggtccagcttacactttcgttctgttactagccctctccacctgcccagcaatttactgtttaaaaggtggctggagccaaaggcatagtcaaggttaatactcctttctctttatcccaaatcagaagcgtttaggctctttttcatcaaatataaaaacacagcccagttcatggctcgttcggcagcaaccctgagacgctttacagccctaaaccctaaaaggtcaaaaggccatcttattctcaatatacattttattacccaaactgctcccgacattaaataaaactccaaaaattggaatctggccctcaaaccccacaacaggacttaattaacctcaccttcaaggtgtacaataataaaaaaaaagttgcaattccttgcctccactgtgagacaaaccccagctacatctccagcacacaagaacttccaaacgcttgaaccgcagccgccaggcgttcctccagaacctcctcccccaggagcttgctataagtgccagaaatctgaccaccaggccaaggaatgcctgcagtccaggattcctcctaagccatgtcccatctgtgcaggaacccactggaaatcggactgttcaactcacctggcagccactcccagagcccctggaactctggcccaaagctctctgactgactccttggcttagcggctgaagattgatgctgcctgatctcctcggaagccccgtagaccatcacagacgccgagattttggtaactctcacagtggagggtaagtccgtccccttcttaatcaatacggaggctacccactccacattactttcttttcaaaggcctgtttcccttgcctccataactgttgtaggtattgacagccaggcttctaaacctcttaaaactccccagctctggtgccaacttagacaatattcttttatgcactcttttttagttatccccctctgcccagttcccttattaggccgagatattttaacaaaattatctgcttccctgactattcctggactacagctgcatctcattgccgcccttcttcccaatccaaagcctcctttgcatcctcctcttgtatccccccaccttaacccacaagtataagatacccctactccctccttggtgaccgatcatgcaccccttaccatctcattaaaacctaatcacccttttaccccactcaatgtcaagatcccatcccacagcatgctttgaaaggattaaagcctgttatcactcacctgctacagcatggccttttaaagcctataaactctccttacaattcccccattttacctgtcctaaaaccagacaaggcttacaagttagtccagaatctgcgccttatcaaccaaattgttttgcctatccaccccatggtgccaaacccatgtactctcctgtcctcagtacctccctctgctacccattattctgttctggatctcaaacatgctttctttcctattcctttgcacccgtcatcccagcctctcttccctttcacttggacttaccctgacacccatcaggctcagcaaattacctgggctgtactgccgcaaggcttcacagacagaccccattacttcagtcaagcccaaatttcatcctcatctgttacctatctcagcataattctcggaaaaacacacgtgctctctctgctgatcgtgtccagttaatctccccaaacctcaatcccttacaaaacaacaactcctttccttcctaggcatggtttgtgtgtcagaattcttacacaagagccaggactgcaccctgtagcctttctgtccaaacaacttgaccttactgttttagcctagccctcatgtctgtgtgcagcggctgccactgctttaatacttttagaggccctcaaaatcacaaactatgctcaactcactctctacatttctcataacttccaaaatctattttcttcctcatacctgatgcatatactttctgctccctgactccttcagctgtactcactctttgttaagtcccacaattaccattgttcctggcacagacttcaatccagcctcccacattattcctgataccacacctgacccccatgactatctctctcatccacctgacattcatcccatttccccatatttccttctttcctgttcctgaccctgatcacacttgatttattgatggcagttccaccaggcctaatcgccacacaccagcaaaggcaggctatgctatagtacaagccactatccctcctcttagaacctctcgtttcctttccattgtggaaatctatccccaaggaaataacttctcagtgttccatctgctattctactactcctcaggaattattcaggccccctcctttccctacacatcaagcttgaagatttgcccccacccaggactggcaaattagctttactcaacatgccccaagtcagataactaaaatacctcttagtctaagtagacactttcactagataagtagaggcctttcctacagggtctgagaaggccaccacagtcatttcttcccttctgtcagacataattcctcagtttagccttcccacctcaatacagtctggtaacagaccagcctttagtagtcaaatcagccaagcagtttttcaggctcttagtattcagtaaaacttttatatcccttatggtcctctgtcttcaagaaaagtagaactgactaaaggtcttttaaaaacacacctcaccaagctcagccaccaacttaaaaaggactggaaagtacttttaccactttcccttctcagaagtcagacctgtcgtcagaatgctgcaaggtgcagcgcatttaagctcctgtatagacgctcctttttattaggccccagtctcatttgacaccagaccaacttagactgtgccccaaaaaaacttgccatccctactatcttctctctagtcatactcctattcaccgttctcaactactcatacatgccctgttcttgtttacactgccagtttacactgtttctccaagccatcacagctgatatctcctggtgccatccccaaactgccactctaaactcttgaagtaaataaataatctttgctggcaggactatgctgaatctccttaggcactctctaatcagatgtcctaggtcctcccaattcttagaccttttatacctgtttttctccttctctttttccatttagtttctcaatccatccaaaaccgtatgcaggtcatcaccaataattctatatgacaaatgtttcttctaacatccccacaatatcacccctttccacaagatctcccttcagcttaatctctcccactctagcttcccacgccaccccaatcccgcttgaagcagccctgagaaacatcgcccattctctcttcataccaccccccaaaaattttcaccgccccaatacttcaacactattttatttttcttattaatataagaaggcaggaatgtccagcctctgagcccaagccaagccatcgcatctcctgtgacttgcacgtatacacccagatggcctgaagtaactgaagatccacaaaagaagtcaaaatagctttaagtgattacattccatcat

SEQ ID NO: 529 - DNA, 7183 bp, Homo sapiens
cagctaccctctttgggtcccctccctttgtatgggagctctgttttcactctattaaatcttgcaactgcattcttctggtccgtgtttgctatggctcaagctttcgctcactgtccaccactgctgtttgccaccgtcgcagacccgccactgactcccatccctcaggatccagcagggtgtctgctgtgctcctgatccagtgaggcacccattgctgttcccgattgggataaaggcttgccattgttcctgcatggctaagtgcccgggttcgtcctaatcgagctgaacactagttactgggttccatggttctcttccatgacccacggcttctaatggagctataacactcactgcatggcccaagattccattcctcggaatacgtggggccaagaactccaggtcagagaacatgaggcttgctatcatcttggaagcagcccgccaccattttggaagtggcctgccaccatcttgggagctctgggagcaaggaacccctggtaacgttttggtgaccgtgaagggacctccaaagtggtgagaaatattggaccactttcacttgctattctgttctatccttccttagaattggaagaaaagaccaggcacctgttggccagttaaaaacgattagcacggccaccggacttaaaactcaggtgtgaggctgtctggggaagggctttctaacaacccccaactcttctgggttgggagcattcatctgcctagaaccagcttccgctttcacttttcttggggaagccaagggccgactagaggcagaaagctgtcatcctgaactcccggcattagcaggttgagatcacggcacagcccgaagtctctattcaacagttgcccatgcgtacacccctacctttccttctgacccatatctcctgggtcctgaccatgactttcttgaaagtgtagccccaaaattcttacctctgaatgtacttcctctgatccccgcctcctaggtactaatggttcagactttaatttcctcgcaagttgtgtctccaaagggatctagggaagctctatgctgcatccttaggcatctaggctataaatgcagggagtcttgtgtccctcgtgtccctcccaatttaggcataccgctctcgacacgggcagttatgtgggacctgttccccaccactcttgccaggaccccaagtttgtaaatggctaaaagagacagagagagagagagagagagagagaggcagagaggtgaaagaggcagagaggagaaagaggcagagaggagaaagaggaagagagacaaagagggactcaaagagagaaagaaagagagatagaaatagtaaaaaaaaaaaaaaaaaaaaaaaaaaaaaaaaaaaaaaaaaaaaaaagtgggccctattcctttaaaagccagggtaaatttaaaacctataattgataattgaaggtcttcttcatgaccctataacactccaatactacccttgttgtcagtgtaaacaaaggcatagcctgaaaacactgagaccactgacaaccatagccttcctatcaaaaatccttaacccggtaacccgtggatgacccaaatgcattcaatctgtagcggcaactgctttgctaacagaagaaagtagaaaagtaacttagaggaaacctcactgtgagcacacctcaccagttcagaattattctaagtcaaaaaagcaaaaaggtagcttactaactcaaaaatcgtaaagtatggggctattctgttagaaaaaggtaatttaacactaaccactggtaagtcccttaacccaacagatttccttacaggagatttaaatcttaattactatacaaaggtccgaccagaccgaggaggaactcccttcaggacaggacgatagatgtttcctcccaggtgactgaggaaaaaaccacaatgggtattcagtaattgatagggagactcttgtggaagcagagttagaaaaactgcctaataattggtctgctcaaacgtgcgagctgtttgcactcagctaagccttaaactacttacagaatcacaaaagactatctcaatcctgactcaaaaagttcgctacaccctttctgaaatgaatttgcataagaactgttgtttatgggaatgcatcttgatggggcagctgggttgttatgaaatactcaggaacccagcccagctctaggactcacccctgagcacaaaggcaatgttaggcatgctggtaaaggaccactagaatccagcagcccgaacccctttctttgtggtcaagaaaggcggtaaaaggggtgtaggaccactacatcggtgagcgtaactagtctgataagcagaggtccatgggtggttacgtgccctggaaaggaataagcattaggaccacagaggacgctctaggactaatgttcttcagaaaatgactaggggtgctggcatccctatgttcttttttcaggtagcaaacattcccctcaaggcaaaaacaccccgaagatgtattctggagaatcgggaccaatttgaccctcagacgctgagaaagaaatgacttatattcttctgcagtattgcctggccacaatatcctcttcatgggggagaaacgtggcctcctgagggaagtataaattatgacaccatcttacagctagacctcttttgtagaaaagaaggcaaatggagtgaagcgccatatgtacaaattttcttttcattaagagacaactcgctattatgtaaaaagtgtgatttatcccctacaagaagccctcagagtgtaccttcctaccccagcatcccccctactccttccccaactaataaggaccccccttcaacccaaatagtccaaaaggagatagacaaaagggtaaacaatgaatcaaagagtgccaatattctccgattatgcccactccaaacagtgggaggaggagaattcggcccagccagagtgcatgtaccattttctctctcagtcttaaagcaaattgaaatagacctaggtaaattctcagctaaccctgatggctatattgatgttttacaagggttaggacaatcctttgatctgacatggagagatataatgttactgttaaatcagacactaaccccaaatgagagaagtgccgccataactgcagcccgagagtttggcgatctctggtatctcagtcaggtccatcataggatgaaaacagaggaaagagaacgattccccacaggccagcaggcagttcccagtgtagaccctcatagggacacagaatcagaacatggagaatggtgcagcagacatttgctaacttgcgtgctagaaggactaaggaaaactaggaagaagcctatgaattattcaatgatgtccagtataacaaagggaaaggaagaaaatcctactgcctttctggaaagactaagggaggcattgaggaggaaaacctgtctgtcacctgactcttttgaaggccaactaatcttaaaggaaaagtttatcactcagtcagctgcagacattagaaaaaaacttcaaaagtcagccttaggcctggagcaaaacttagaaaccctactgaacttggcaacctcggtttttttataatagagatcaggaggagcaggcggaatgggacaaacgggataaaaaaaaggccaccgctttagttatagccctcaggcaagtggactttggaggctctggaaaagggaaatgctgagcaaattgggtgcctaatagggcttgcttccagtgcagtctacaaggacattttaaaaaagattatccaagtacaaataagccaccccctcgtccatgcccgttatatcaagggaatcactggaaggcccagggccccgggggatgaaggtcctctgagtcagaagccactaaccagatgatccaacagcaggactgagggttcccggggcaagcaccagcccatgccatcaccctcatagagccctgggtatgcttgacctttgagggccaggaggttaactgtctcctggacactggcacggccttctcagtcttactgttctgtcctggacaactgtcctccagatctgtcactatccgaggggtcctaggacagccagtcactagatacttctcccaggcactaagttatgactggggaactttactcatttcacatgcttttctaattatgcctgaaagccccactcccttgttagtgagagaaattctagcaaaagcaggggccattacacacctgaacataggagaaggaacacccgtttgttgtcccctgcttgaggaaggaattaatcctgaagtctgggcaacagaaggacagtatggatgagcaaagaatgccatcctgttcaagttaaactaaaggattctgcctcctttccctaccaaaggcagtaccccttagacccaaggcccaacaaggactccaaaagattgttaaggaccgaaaagcccaaggcctagtaaaaccatgcaatagcccttgcaatattccaattttaggagtacagaaacccagtggacagtggaggttagtgcaagatctcaggattatcgattaggctgttgttcctctatatccagctgtacctaacccttataccctgctttcccaaataccagaggaagcagagtggtttacagtcctggaccttaaggatgtctttttctgcatccctgtacattctgactctcaatttttatttgcctttgaagatccttcgaacccaatgtctcaactcacctggactgttttaccccaggggttcagagatagcccccatctatttggccaggcattagcccaagacttgagccaattctcatacctggacactcttgtcctttggtacatggatgatttacttttagccacccattcagaagccttgtgccatcaagccacccaagcactcttaaatttcctcgctacctgtggctacaagattccaaaccaaaggctcagctctgctcacagaagtttaaatacttagggctaaaattatccaaaggtaccagggccctcagtggggaacatatgcagcctatactggcttgtcctcatcccaaaaccctaagcaactaagagggttccttggcataacaggtttctgccaaatatggattcccaggtatggcaaaatagccagatcattatatacactaattaaggaaactcagaaagccaatacccatttagtaaggtggacacctgaagcacaagcagctttccaggctctaaagaaggctctaacccaagttccagtgttacgcttgccaaaggggcaagatttttctttaaatgtcacagaaaaaaacagaaatagctctaggagtccttacacaggtccgagggatgaacttgccaactgtggcatacctgagtaaggaaattgatgcagtggcaaagggttggcctcattgtttatgggtagtggcagcggtagcagtcttagtatctgaagcagttaaaataatacatggaagagatcttactgtgtggacatctcatgatgtgaacggcatactcactgctaaaggagacttgtggctgtcagacgatcgtttacttaaacatcaggctctattacttgaagggcctgtgctgcaactgcgcgcctttgcaactcttaacccagccacatttcttccagacaatgaagaaaagatagaacataactgtcaacaagtaattgctcaaacctaccccgctcgaggggaccttttagaggttcccttgactgattccgaccttaacttgtatactgatggaagttcctttgtagaaaaaggaccttgaaaagtggtcagggataatggaatacttgaaaataatcccctcactccaggaactagtgctcagccggcataactaatagccctcactcgagcactagaattaggagaaggaaaaagggtaaatatacatatagactctaagtatgcttacctagtcctccatgcccatgcagcaatatggagagaaagggaattcctaacttctgagggaaaacctatcaaccatcaggaagccattaggagattattattggctgtacagaaacccaaagaggtggcagtcttacactgctagggtcatcagagaagaaaggaaagggaaatagaagggaaccaccaagcagatattgaagccaaaagagctgcaagacaggaccctccatcagaaatgcttatagagggacccctagtgtggggtaaccccctccaggaaaccaagccccagtactcagcaggatgaatagaatggggaacctcatgaggacatactttcctcccctgaggatggctagccaccaaagaaggaaaaatacttttgcctgcagctaaccaatggaaattacttaaaacccttcaccaaaactttcacttagacattgatagcacccatcagatggccaaattattatttactggaccaggccttttcaaaactatcaagcagatagtcagggcctgtgaagtgtgccaaagaaataacccctgcactgcaggccatacctttcaatccctgtacctttaacctccttgttaagtttgtctcttccagaatcgaagctgtaaaactacaaatggttcttcaaatggagccccagatgcagtccatgactaagatctactgcagacccctggactggcctgctagcctcatgctccaatgttaatgacattgaaggcaactctcccgaggaaatctcaactgcacaacccctactacaccccagttcagcaggaagcagttagagcaatcattggccaacctccccaacagcacttgggttttcctgttgagaggggggactgagagcaggactagctggatttcctaggctgactaagaatccctaagcctagctgggaaggtgactgcacccacctttaaacacggggcttgcaacttagttcacacctgaccaatcaagtagtaaagagagctcactaaaatgctaattaggcaaaaacaggaggtaaagaaatagccaatcatctatcacctgagagcacagcgtgggggacaatgatcaggatataaacccaggcatttgagccagcaatggctaccctctttgggtcccctccctttgtatgggagctctgtttacactctattaaaccttgcaactgca

SEQ ID NO: 530 - DNA, 2847 bp, Homo sapiens
gtcaggcctctgagcccaagctaagccatcatatcccctgtgacctgcaggtatacatccagatggcctgaagcaagtgaagaatcacaaaagaagtgaaaatggctggttcctgccttaactgatgacattactttgtgaaattccttctcctggctcagaagctcccccactgagcaccttgtgacccccacccctgcccgccagagaacaaccctctttgactgtaattttccactacctacccaaatcctataaaatggccccacccctatctcccttcactgactctctttttggactcagcctgcctgcacccaagtgaaataaacagccttattgctcaggcgctgtctgtttggtggtctcttcacatggacgtgtgtgacatttggtgcctgttatcactcccctgctacagcatgggcttgtaaaacctataaactctccttacaattctcccattttacctattcaaaaaccagacaagtcttacaggttagttcagcatctgcactggccgtcatgtctccatgtagcagctgccatcaccctaatacttttagaagccctaaaaatcacaaactatgctcaactcactctctacagttctcataacttccaaaatctattttcttcctaacacctgatgcgtatactttctgctccccagctccttcagctatactcactctttgttgcgtctcccacaattaccatttttcctggcccggacttcaatctggcctcccacattagtccggataccacacctgacccccacgactgtatctctctgatccacctgacattcactccatttccccatatttccttctttcctgttcctcaccctaagcacacttggtttattgatggcagttccaccaggcctaattgccactcaccagcaaaggcaggctatgctgtagtatcttccacatctatcattgaggctaccgctctgccccactcccctacctctcagcaagccaaactcattgccttaactcgagcgtcactcttgcaaagggactacacgtcaatatttaaactgactctaaatatgccttccatatcctacgccaccataccattatttgggcagaaagaggtttcctcactgcgcaagggtcctccatcattaatgcctctttaataaaagctcttctcaaggccactttacttccaaaggaagctggagtcattcactgcaaaggccatcaaaaggcatcagatcccattgctcagggcattgcttatgctgataacatagctaaagaagcagctagcattccaacttctgtccctcatggccagtttttctccttctcatcggtcactcccacctactcactgactgaaacttctatcagtctcttcccacacaaggcaaatggttctttgaccaaggaaaatatctccttccagcctcacaggcccattctattctgtcgtcattgcataacctcttccatgtaggttacaagctgctagcccacctcttagaacatctcatttcctttccattgtggaaatctatcctcaaaaaatcacttctcagtgttccatctgctattctactactcctcagggattattcaggccccctcccttccctatacatcaagctcagggatttgcccccacccaggactggcaaattgactttactcacatgctctgagtcaggaaactaaaatacctcttggtctgggtagacactttcactggatgggtagaggcctttcccacagggtctgagaaggccaccatgatgatttcttcccttctgtcagacataattctttggtttggccttccctcctctatacagtctgataacggaccagcctttattagtcaaatcacccaagcagtttcttaggctcttggtattcagtaaaacctttataccccttaacatcctgaatcttcaggaatggtagaacagactaattgtcttttaaaaacacacctcaccaagctcagcctccaacttaaaacttaaaaaagaggactctgtcaaggatagagccccaaaactcaccaaccaaacaagtaattatgctgaactcccttgagcactctctaattggatgtcctgggtcctcccaattcttagtcatttaatacctgtttttctccttcacttattcacaccttgtgtcttccgtttagtttctcaattcatacaaaaccgcatccaggccatcaccaatcattctatatgacaaacgctcctcttaacaagcccacaatttcaccccttaccacaaaatcttccttcagcttaatctctcccactctaggttcccatgcctcccctaaccccactcgaagcagccctgagaaacatcgcccattatctctccatagcacccccaaaaattttcaccaccccaacacttcaacactattttgttttatttttcttattaatataagaagacaggaatgtcaggcctctgagcccaagctaagccatcatatctcctgtgacctgcatgtatacatccagatggcctgaaacaagtgaagaagcaaaagaagtgaaaatggctggctcctgccttaactgatgacattactttgtgaaattccttctcctggctcagaagctcccccactgagcaccttgtgacccccacccctgcctgccagagaataaccccctttgactgtaattttccactacctacccaaatcctataaaatgcccacccccgcccatcttccttcactgactctcttttcggactcagcctgcctgcacccaggtgaaataaacagtcttgttgctcacaaaaagcctgtttggtggtctcttcacactgatgcacgtga

SEQ ID NO: 531 - DNA, 5758 bp, Homo sapiens
gtcaggcctctgagcccaagccaagccatcgcatcccctgtgacttgcacgtatatgcccagatggcctgaagtaactgaagaatcacaaaagaagtgaatatgccctgccccgccttaactggtgatattccaccacaaaagaagtgtaaatggccggtccttgccttaagtgatgacattaccttgtgaaagtccttttcctggctcatcctggctcaaaaagctcccccactgagcaccttgtgacccccactcctgcctgccagagaacaaaccccctttgactgtaattttcctttacctaaccaaatcctataaaacggccccaccccaatttccctttgctgactctcttttcagactcagcccacctgcccccaggtgaaataaactgccatgttgctcacacaaagcatggttcgtggtctcctcacacagacgcacatgaaatttggtgccgtgactcggatcgggggacctcccttgggagatcaatcccctgtcctcttgttctttgcttcatgagaaagatccacctacaacctcaggtcctcagaccgaccagcccaagaaacatctcaccaatttcaaatctgttaagtggcctctttttactctcttctccagcctccctcactatccctcaatgtctttctcctttcaatcttggtgctacacttcaatctctcccttctcttaatttcaattcctttcattttctggtagagacaaaagagacgcgttttatctgtggacccaaaactccggcgccggtcacagactgggaaggcagccttcccttcgtgtttaatcattgcagggagacctgtctgattatacacccacgtttcaagggtgtcagaccacgcagggacacctgccttggtccttcacccttagtggcaagtcccgcttttctggggaaggggcaagtaccccaaccccttctgtccttgtctctaccccttctctgcttttccggggacagggcaagtaccccaaccccttctctccttgtctctaccccttctctgcttttctgggagaggggcaagtacccctcaaccccttctccttcacccttagcagcaagtcccacttttctacggggcaagaacccccaatcccttatttctgtgtcccaacctcttatctctgtgccccaatcccttatttctgtgccctgacctcttatctgtgccccaaccccttttcccacttttctggaaagtaagaacccccgaaccccttccctccgtttctctactctctcttttctctaggcttgcttccttcactatgggaaccttccaccctccattcctccttctactcccttggcctgtgttctcaaaaacttaaaacctcttcaactctcacctgacctaaaacctaagtgccttattttcttctgcaatgcctcttgaccccaatacaaactcgacagtagttccaaatagccagaaaatggcactttgaatttttccatcctgcaagatctaaataattcttgccataaaataggcaaacggtctgaggtgcctgatgtccaggcattcttttacacatcagttcctttgcccagtgcaactcgtcccaaatcttccttctttccctcccgcctgtcccctcagtcccaaccccaagcgtcgctaagtctttctaatcttccttttctacagacccatctgacttctcccctccttgccagcccaagctaggtcccaattcttcctcagcctccgcttctccactctgtaatctttttatcgcctcccctcctcacacctggtctggcttacagattccttctgtgactagccctccccaacctgcccagcaatttactcttaaaaaggtggctggagcaaaaggcatagtcaaggttaatgctcctttttctttatcccaagtcagatagcgtttaggctctttttcatcaaatataaaaacccagcccagttcatggcttgtttggcagcaaccctgagaggctttacagccctagaccctaaaaggtcaaaaggccatcttattctcaatatacattttattacccaatctgctcccgacattaaataaaactccaaaaattaaattccggccctcaaaccccacaacaggatttaattaacctcgccttcaaggtgtacaataacagaaaaaagttgcaattctttgcctccactgtgagacaaaccccagccacatctccagcacacaagaacttccaaacgcctgaactgcagcagccaggcgttcctccagaacctcctcccccaggagcttgctacaagtgccagaaatctgaccaccaggccaaggaatgcctgcagcccaggattcctcctaagccatgtcccatctgtgtgaccccactggaaattggaccgttcaactcacctggcagccactcccagagcccctggaactctggcccaaggctctctgactgactccttcttggcttagcggctgaagactgacgctgcccaatcgccttggaagccccgtagaccatcatggacgctgagctttgggtaactctcacagtggaaggtaagtccgtccccttcttaatcaatatggaggctacccactccacattaccttcttttcaagggcctgtttcccttgcctccataactgttgtgggtattgacagccaggcttctaaacctcttaaaactccccaactctgctgccaacttagacaatactcttttaagcattcctttttaattatccccacctgcccagttcccttatgaggctgagacactttaactaaattgtctgcttccctgactattcctggagtacagctatatctcattgccacccttcttcccaatccaaagcctcctttgcatcctcctcttgtatccccccaccttaacccacaagtataagatacctctactccctccttggtgaccgatcatgcaccccttaccatctcattaaaacctaatcacccttaccccactcaacgccaatatcccatcccgcagcacgctttaaaaagattaaagcctgttatcactcgcctgctacagcatggccttttaaagcctataaactctccttacagttcccccattttacctgtcctaaaaccagacaagccttacaagttagttcaggatctgcgccttatcaaccaaattgttttgcctatccaccccgtggtgccaaacccatatactctcctatcctcagtacctgcctctacaacccattattctgttctggatctcaaacatgctttctttactattcctttgcacctttaatcccagcctctcttcgctttcacttggactgaccctgacacccatcaagctcagcaaattacctaggctgtactgccgcaaagcttcacagacagcccccattacttcaatcaagcccaaatttcttcctcatctgttacctatctcggcataattctcataaaaacacacgtgctctccctgccaatcgtgtccgactgatctctcaaaccccagcaccttctacaaaacaacaactcctttccttcctaggcatggttagtgtggtcagaattcttacacaagagccaggaccatagcccgtagcgtttctgtccaaacaacttgaccttactgttttagcctagccctcatgtctgtgtgcagcggctgccactgctttaatacttttagaggccctcaaaatcacaaactatgctcaactcactctctacagttctcataacttccaaaatctattttcttcctcatacctgacgcatatgctttctgcttcccggctccttcagctatactcactgtttgttgagtctcccacaattaccgttgttcctggcccagacttcaatccggcctcccacattattcctgataccgcacctgaccccctgactatatctctcttatccacctgacattcaccccatttccccaaatttccttctttcctgttcctcaccctgctcacgcttgatttattgatggtggttccaccaggcctaatcgccacacaccagcaaaggcaggttatgctatagtacaagccactagcccgcctcttagaacctctcatttcctttccatcgtggaaatctatcctcaaggaaataacttctctgtgttccatttgctattctactactcctcagggattattcaggccccctcccttccctacacatcaagctcgaggatttgccccacccaggaatggcaaattagctttactcaacatgctctgagtcagataactaaaatacctctaagtctagatactttcactggataggtagaggcctttcctacagggtctgagaaggccactgcagtcatttcttccgttctgtcagacataattcctcagtttagccttcccacctcaatacagtctgataacagatgagcctttattagtcaaatcagccaagcagtttttcaggctcttagtattcagtgaaacctttatatcccttacggtcctccgccttcaagaaaagtagaatggactaaaggtcttttaaaaatacacctcaccaagctcagccaccaacctaaaaaggactggacaatacttttaccacttgcccttctcagaattcaggcctgtcttcggaatgctacagggtacagcccatttaagctcctgtatagacgctcctttttattaagccccagtctcattccagacaccagaccaacttagactgtgccccaaaaaacttgtcatccctactaccttctgtctagtcatactcctattcaccgttctcaactactcatacatgccctgctcttgtttacactgccggtttacactgtttttccaagctatcacagctgatatctccaggtgctatccccaaactgccactcttaactcttgaagtaaataaataatctttgttggcaggactatgctgaatcttcttaggcactctctaatcagatatcctgagtcgtcccaattcttagaccttttatacctgtttttctccttctgttaccatttagtttctcaattcatccaaaaccgtatccaggccatcaccaatcattctatacaacaaatgtttcttctaacatccccacaatatcaccccttaccacaagacctcccttcagcttaatctctcccactctaggttcccacgccgcccctaatcccgcttgaagcagccctgagaaacatcgctcattctctctccataccaccccccaaaaattttcgccaccccaacacttcaacactattttgttttatttttcttattaatataagaagtcaggaatgtcaggcctctgagcccaagccaagccatcgcatcccctgtgacttgcacgtatatgcccagatggcctgaagtaactgaagaatcacaaaagaagtgaatatgccctgccccgccttaactggtgatattccaccacaaaagaagtgtaaatggccagtccttgccttaagtgatgacattaccttgtgaaagtccttttcctggctcatcctggctcaaaaagctcccccactgagcaccttgtgacccccactcctgcctgccagagaacaaaccccctttgactgtaattttcctttacctaaccaaatcctataaaacggccccaccccaatttccctttgctgactcttttcggactcagcccgcctgcacccaggtgaaataaacagccatgttgctcgcacaaagcctgtttggtggtctcttcacacggacgcgcatgaaa

SEQ ID NO: 532 - DNA, 368 bp, Homo sapiens
gtcaggcttctgagcccaagcctgcacttatacatccagatggcctgaggcaactgaagaaccacaaaaagaagtgaaaatagccagttcctacctttactgatgacattaccttgtgacattccttctcctggacaatatgtctccagctctccccaccaagcaccttgtgacccctgcccccacctgcaagagaataaccccctttaactgtcattttccactacctacctaaatcctataaaactgcccccacccctatctccctttgctgactcctttttccgactcactccgcctgcacccaggcgattaaaaagctttattgctcacacaaagcctgtttggtggtctcttcacacagacac

SEQ ID NO: 533 - DNA, 865 bp, Homo sapiens
caaggatagagcccaaaaacttgccaaccaagcaaataattatgctgaacccccttgggcactctctaattggatgttatgggtcctcccaattcttagtcctttaatacctgtttttctccttctcttattcggaccttgtgtcttctgtttagtttctcaattcatacaaaaccatatccaggccatcaccaatcattctatatgacaaatgctccttctaacaaccccacaatatcaccccctaccccaaaatctttctttagtttaatctctcccactgtcggtttccacgccgcccctgatcctgcttgaagcagccctgagaaacatggcccattatctctccatgccacccccaaacattttcgccgccccaacacttcaccactattttgttttgtttttcttattaatataagaagacaggaatgtcaggcctctgagcccaagctaagccatcataacccctgtgacctgcacatatacatccagatggcctgaagcaactaaagaaccacaaaatgagaaatagcaagttcctgccttaactgatgacattccaccattgtgatttgttcctgccccaccctaaccgatcaattgaccttgtgacattccttctcctggacaatgagtctcaggagctccccactgagcaccttgtgacccccactgctgcccacaagaaaaaacttttaactgtaatattctactacctacccaaatcctataaaactgccccacccctgtctccctttgctgactcctttctcggactcagtccacctgcacccatgtgattaaaaagctttatggctcacacaaagcctgtttggtggtctcttcacacggacgcatgtaa

SEQ ID NO: 534 - DNA, 1077 bp, Homo sapiens
cccttattttgctctgacattcttctaaatctaataacctgatatgcttcctctagccttcaggccatcaagctccagatgatcctcagtgagggttaacttcctctcaatattcaagagtaacccttctacagacccccagactgcccattagtgagacatgacagaggcaaaatcttgtccctgtctcccttggacctggctggatactgctttcaccaacccatggagccaccctcctgccctgacatctagcaaagaggccaagatccacagaacaaccaccaccatcaccccgctggaagcaggaagcagttacagaagactgaggttcatgcattttcttcaaataattgtgatcttggtctcttgggtgggagaatattacagtggctagtcaggcatgaacagggcaggggagggctgcctcgcatacatcaggaatgtcaggcagccatcaggtgattgttaggcagttgttaattgtctctctaaaataatatttggtccctgctggcaccagggagaggcagtctcccaatagatagaaataacctgacactggtgattagcagcttcccaataagatctcaggcattaggaaagtgggctcaagcatgtgcattaagaggcaaaatagcagagtttaactggtatatgaccatccagggacattcaactgctaagggaagaatgcctcaagtgagcatgcatacaactccactaaacatactgtgcatgcttacctcccacatgctagcaggccagtgtgcatgcagacagcccacctgaagggaagaatcaagggagaagggatgcaagactctggaagtatgccagcatataaaaccccaagtcaaaggtcaaacagggcacttgatctcttaagtcacctgcttggccctctttcaactgtactttatttcctttcatttctgctctaaagcttcttaataaactttcactcctgctctaaaacttgcctgggcctctccttctaacttctgcccctcagtcaaattctttcttctgaggaggcaagaattgaggttgctgcagacccatatagatttgcca

SEQ ID NO: 535 - DNA, 430 bp, Homo sapiens
gtcagacctctgagcccaagctaagccatcatatcccctgtgacctgcacgtatacatccagatggcctgaagcaagtgaagaatcacaaaagaagtgaaaatggccagttcctgccttaactgatgacattccaccattgtgatttgtttctgccccaccttaactgagcgattaaccttgtgaaattccttcccctggctcagaagctccctgactgagcaccttgtgaccctgggccctgccctccggagaacaactccctttgactgtaattttccactacctacccaaatcctataaaacggccccacccctaatctcccttcgctgactcttttcggactcagcccgcctgcacccaggtgattaaaaagctttattgctcatacaaagtctgtttggtggtctcttcacacgaacgcgcgtga

SEQ ID NO: 536 - DNA, 983 bp, Homo sapiens
gtgggggaaagaaagagagatcagactgttactgtgtctatgtagaaaaaggaagacataagaaactccattttgatctgtactaagaaaaattcttctgccttgagatgctgttaatctgtaaccctagccccaaccctgtgctcgcagaaacgtgtgctgtattgactcaaggtttaatggatttagggctgtgcaggatgtgctttggtaaaaatgtgtttgcaggcagtatgcttggtaaaagtcattgccattctccagtctcaagtaaccagggacaccatacactgcggaaggcagcagggacctctgcccaagaaaacctgggtattgtccaagatttcccccactgagacagcctgagagatggcctcgtgggaagggaaagacctgaccgtcccccagcccgacacccataaaaggtctgtgctgaggaggattagtgaaagaggaaggcctctctgcagttgagataagaggagggcatctgtctgctgctcgtccctgggaatggaatatctcggtgtaaaacccgatcgtacattctatttactgagataggagaaaactgccttatggctggaggtgagacacactggcagcaatactgctctttactgcactgagatatttgtgtaaagtcaaacataaatctggcctacgtgcacatccaggcacagctcctttccttaaatttatctatgacaccgagtcctttgctcacgttttcctgctgaccctctccccaccattaccctatagtcctgccacatccccctcaccgagatagtagggatagtgatcaataaatactgagggaactcagagaccagtgccggtgcaggtcctcacttgctgagcaccggtcccctgggcccacttttcttcctctatactttgtctctgtgtcttatttcttttctcagtctctcgtctccaccttgtgagaaatactcagaggtgtggaggggcaggccccc

SEQ ID NO: 537 - DNA, 6062 bp, Homo sapiens
gtcaggcctctgagcccaagcctgcacgtatacatccagatggcctgaagcaagtaaagaatcacaaaagaaatgaaaatggctggttcctgccttaactgatgatattgccttgtgaaattccttctcctggctcagaagctcccccactgagcaccttgtgaccccccgcccctgcccgcaagagaacaaccccctttgactgtaattttccactaccacccaaatcatataaaactgccccacccctatctcccttcgctgactctctttttggactcagcccgcctgcacacaggtgaaataaacagccttgttgctcacacaaagcctgtttggcctgtttggtggtctcttcacacggatgcgcatgacatttggtgccaaaacccaggacaggaggactccttcgggagactggtcccttgtactcgccctcactccgtgaggagatccacctgcgacctcaggtcctcagaccaaccagcccaaggaacatctcaccaatttcaaatcgggtaagcagtcttttcactctcttctccagcctctctcactacccttcaatctccctgtccttccaaatccagttctttttcctctctagtacagacaaaggagacacattttatccgtggacccaaaactctggcgccggtcatgggctcgggaagacagtcttccgttggtgtttaatcactgcagggacacctgcctgattattcacccacactccattggtgtctgatcaccacggggatgcctgtcttagtcattcacccacattcccttggtggcaagtcaattgcggggaagcctgctttggcttctcacccacattgcagcccagtgctgctcaccaacccccttctctgtgtctccactctctcttttctctgggcttgcctccttcaccatgggcaacctttcaccctccattcccccttcttctcccttagcctgtgttctcaagaatttaaaacctcttcaactcttgcgtgacctaaaacctaagcatcttattttcttctgcaacaccgcttagccccagtacaaactcaataatggttctaaatagccagaaaacggcacttttgacttctccattttacatcaacatggatgatttttgtcaaaaaatgagcaaatggatctcaggtacctgatgtccaggcattcttttacacactcatccctccctagtctctgctcccaatgcgactcaccccaaatctttcttctttctctcctgtctgttccttcagtctctaccccaagctctgagtcttttcaatcttctttttctactgacccatttgacctctcccctcctccccagactgctcctcaccaggctaagccaggtcccaattcttcctcagcctccacacccccaccctataatccttttatcaccttccctcctcacaccctctccggcttacagtttcgttctgcgactagccctccccaacctgcccaacaatttcctcttaaagaggtggctggaactgaaggcatagccaagattaatgcttctttttctttatcagacctctcccaaatcagttagcgtttaggctctttttcatcaaatataaactcaacccagttcatggcccatttggcaacaacccttagacgctttaccgccctagacccagagaggccagaaggccatctcattcttaatatgaattttattacccaacccatacctgacattagaaaaagctccaaaaattagattccagccctcaaaccccacaacaggacttaactgaccttgccttcaaggtgtgtaataatagagtagaggcagccaagtagcaacgtatttctgagttgcaattccttgcctccactgtgagacaaactccagccacatctccagcactcaagaacttccaaatgcctgaaccgcagaggccaggaattcctccaggacagcctccaccaggatcttgcctcaagtgccggaaatctggccactgggcaaggaatgcccgcagcccaggattcctcctaagccatgtcccatctgtgagggaccctactggaaactggactgtccaacttgccccacagccactcccagagcccctggaactctggcctaaggttctctgactgactccttcacagatcttcccagcttagcggctgaagaccaacactgcccaatcaccttggaaacctcctggatcatcacagacactttgggtaactcttacagtggaaggtaagtccatcaccttcttaatcaatacagaagctacccactacacattaccttcttttcaagggcctgtttcccttgcctccataactgttgtgggtattgatggccaggcttctaacctcttaaaactccccaactctgatgccaacttggacaacattcttctatgcactcctttttagttatcctcacctgcccagctcccttattaggtcaagacattttaactaaattatctgcttctctgactattcctgggctatagccacacctaattgctgcccttttccccagttcaaagcctccttcacatcctccccttctatctccccaccttaatccacaagtataggacacctctactccctccttggtgaccaatcatgcaccccttaccatcccactaaaacctaatcacccttaccctgctcaacgcctatatcccctcccacagcacattttaaaaggattaaagcctgttatcacttgcctgttacagcatggccttttaaagcctataaactatccttacaattcccccattttacctgtccaaaaaccagaccagccttacaggttagttcaggatctgtgccttatcaaccaaattgtcttgcctatccaccccatggtgccaaagccatgtactctcctatcctcaatacctccctccacaacccctccataacccattattctgttctggatctcaaacatgatttctttactgttcgtttgcacccttcatcccatcctctctttgctttcacttggactgaccctgacatccatcagcctcagcaacttacctgggctgtactgctgcaaggctgcagggacagcccccattacttcagtcaggctcaaattttttccttacccattacctatctcagcataattcttcatgaaaacacacgtgctctccctgctgggtcgtgtctggctaatctcccaaaccccaaccccttctacaaaataacaactccttttcttcctaggcatggttaggtactcctgcctttggatacctagttttaccatcctgactgaaccattatataaactcacaaaagccaacctagctgaccccacagatcctaaatcctttcaccactcctcttttcgttccttaaaaacagccctagaagctgctcccacactaactctaattcatcccaacccttttcattatacacagccaaagtacacggctgtgcggtcaaaattcttacacaagagccgggaccacgccctgtagcctttctgtccaaacaacttgaccttactgttttaggctggcccccacccccatgactgtatctctctgatccacctgacattcactccatttccccatatttccttatttcctgttcctcaccctgatcacacttggtttattgatggcagttccaccaggcctaatcgccattcaccagcaaaggcaggctaatgcaatagtatcttccacatctatcattgaggctaccactctgccccctccactacctctcagcaagctgaactcattgccttaacttgagccctcactcttgcaaggactatgcgtcaatatttatactgactctaaatatgccttccatatcctgcaccaccatgctgttatatgggcagaaaaaggtttcctcactctgcaaaggtcctccatcattcatacctctttaataaaaactcttctcaaggccgctttacttccaaaggaagctggagtcattcattgcaagggccatcaaagggcatcagatcccatcactcagggcaatgcttatgctgataaggtagctacagaagcagctagcgttccaacttctgtccctcacggccagtttttctccttatcatcagtcgctgccacctactcccccattgaaacttccacctatcaatctcttcccatatgaggcaaactgctcttagaccaagaaaagtatctccttccagcctcacagtcccattctattctgtcgtcatttcataacctcttccatgtaggttacaagctgctagcccatctcttagaacctctcatttcctttccattgtggaaatctatcctcaaggaaatcacttctcagtgttctatctgctactctactactcctcagggattgttcaggcccctcccttccctacacaacaagcttggggatttgcccccagccaggactggcaaattgactttactcacacgccccgagtcaggaaaataaaatacctcttggtctaggtagacactttcactggatgggtagaggcctttcccacaaggtctgagaagaccaccatggtcatttcttcccttctgtcagacataattcctcagttttgccttcccacctctatacagtccaataacagactggcctttactagtcaaatcacccaagcagtttctcaggctcttggtattcagggaaaccttcataccccttaccgtcctcaatcttcaggaaaggtagaacggactaacggtcttttaaaaacacacctcaccaagctcagcctccaacttaaaaaggaggactctgtcaaggatagagcccaaaaactcaccaaccaagcaagtaattacgctgaacccccttagggactctctaattggatatcctgggacctcccaattcttagtcttttaatacctgtttttctccttctcttattttgaccttgtgtcttccatttagtttttcaattaatacataactgcatccaggccatcaccaatcattctatatgacaaatattccttctaacaaccccaaaatatcaccccttaagggaggagaccaccgctcatactgtcttatgcccaatttctgcctcaaaagaaagaagtaaaaactaaaaggcagaaatgaaatccacaagcagacagccccggcaccataccctgggcctggtagttaaagatcgatgacccctgacctaatcggttatgttatctatagattacagacactgtatagaaaagcactgtgaaaatccctgtcctgttctgttccgttctaattaccggtgcacgcagcccccagtcatgtaccccctgcttgctcaatcgatcatgaccctctcacgcagacccccttagagttatgagcccttaaaagggacaggaattgcacactcggggagcttggttgttagagacgtgaatcttgccaaagctcctggccaaataaaggccttccttctttaactcagtgtctgagggtttttgtctgtggcttgtcctgctacacccttaccacaaaatcttccttcagcttaatctctcccactgtaggtttccacgctgcccctaatcccgctgaaagcagccctgagaaacatcacccattatctccccataccacccccaaacatttttgccaccgtaacagttcaacactattttgtttatttttcttattaatataagaagacaggaatgtcaggcctctgagccaagcctgcacgtatagatccagatggcctgaagcaagtgaagaatcacaaaagaagtaaaaatggctggttcctgcctcaactgataacattaccttgtgaaattccttctcctggctcatcctggctcaaaagctcccccactgagcactttgtgacccccacccctgcccaccagagaacaaccccctttgactgtaattttctactacccaaatcctataaaacagccccacccctatttcctttaactgactctcttttcagactcagcccacctgcacccaggtgaaataaacagccttgttgctcacataaagactgtttggtctcttcacacggatgtgtgtga

SEQ ID NO: 538 - DNA, 2167 bp, Homo sapiens
cgcagtcagaattcttacacaagagccaggaccacaccctgtagcctttctgtccaaacaacttgaccttactgttttagcctagccatcatgtctgcgtgcagtggctgccgctgctttaatacttttagaggccctcaaaatcacaaactatgctcaactcactctctacagctctcataacttccaaattctattttcttcctcacacctgacgcatatactttctgcttcccggctccttcagctgtactcactctttaagtcccacaattaccattgtttctggcccagacttcaatccggcctcccacattattcctgataccacacctgacccccatgactgtatctctctgatccacctgacattcaccccatttccccacatttccttctttcctgttcctcaccctgatcactcttgatttattgatggcagttccaccaggcctaatcgccacacaccagcaaaggcaggttatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagctggaggatttgccccacccaggactggcaaattagttttactcaacatgccctgagtcagataactaaaatacctcttagtctaggtagatactttcactggataggtagaggcctttcctacagggtctgagaaggccaccgcagtcatttcttcccttctgtcagacataattcctacagtctgataacagatgagcctttattagtcaaatcagccaagcagtttttcaggctcttagtattcagtgaaacctttatatcccttacggtcctccatcttcaagaaaagtagaacggactaaaggtcttttaaaaacacacctcaccaagctcacccagcaacttaaaaaggactggacaatacttttaccactttcccttctcagaattcaggcctgtcctcggaatgctacagggtacagcccatttaagcttctgtatagacgctcgtttttattaggccccagtctcattccagacaccagaccaacttagactgtgcccccaaaaaacttgtcatccctactatcttctgtctagtcatactcctattcgttctcaactactcatacatgccctgctcttgtttacactgccggtttacactgtttttccaagccatcacagctgataatctcctggtgctatccccaaactgccactcttaactcttgaagtaaataaataatctttgcgggcaggactatgctgaatctccttaggcactctctaatcagatatcctgagtcgtcccaattcttagaccttttatacctgtttttctccttctgttattccatttagtttctcaattcatccaaaactgtatacaggccatcaccaatcattctatacgacaaatgtttcttctaacatccccacaatatcaccccttaccacaagacctcccttcagcttaatctctcccactctaggttcccacgccacccctaatcccgcttgaagcagccctgagaaacatcacccattctctctccataccaccccccaaaaattttcgccgccccaacacttcaacactattttgttttattttgcttattaacataagaaagcaggaatgtcaggcctctgagcccaagccaagccatcgcatcccctgtgacttgcatgtatacgcccagatggcctgaagtaactgaagaatcacaaaagaagtgaatatgccctgccccaccttaactgatgacattccaccacaaaagaagtgtaaatggccggtccttgccttaagtgatgacattaccttgtgaaagtccttttcccggctcatcctggctcaaaaagcacccccactgagcaccttgcgacccccactcctgcccaccagagaacaaacccccttgactgtaattttcctttacgtacccaaatcctataaaacgcccccccgacacttatctgccttttcggactcagcctgcctgcacccaggtgaaataaacagccatgttgctcacacaaagcctgtttggtggtctgttcacacagacgcgcatgaaa

SEQ ID NO: 539 - DNA, 5728 bp, Homo sapiens
gtcaggcctctgagcccaagctaagccatcatatcccctgtgacctgcacgtacacatccagatggccggttcctgccttaactgctgacattccaccatgaaagaagtgaaaatggcctgttcctgccttaactgatgacattgtcttgtgaaattccttctcctggctcatcctggctcaaaagctcccccactgagtaccttgtgacccccactctggcctccagagaacaacccccctttgactgtaattttcctttacctacccaaatcctataaaacggccccacccctatctcccttcgctgactctcttttcggactcagcccacttgcacccaggtgaaataaacagccatgttgctcacacaaagcctgtttggtggtctcttcacatggacgcacatgaaatttggtgccgtgactcggatcgggggacctcccttgggagatcaatcccctgtcctcctgttctttgctctgtgaaaaagatccacctacgacctcaggtcctcagacccaccagcccaagggacatctcaccaattttaaattgggtaagcaacctcttcttactctcttctccaacctttctcactatccctcaaccactttctcctttccactcttcaatctctcccttctcttaatttcaattcctttcattttctggtaaagacaaaggagacatgtttcatccgtggacccaaaactctggcgccagtcacggactgggaaggagccttcccttggtgtttaatcattgcagggacgcctctctgattattcaccccttctctgcctttctggggggcaagaaacccccaacctcttctccttcacccttagcagcaagtcccacttttctgggggaggggcaaatatcccaacctcgtatctctgtgccccaataccttatttctgtgccccgacctcttatctctgcaccccaatcccttatttccacaccctgacctcttatatctctgtgccccaatcccttatttccatgccccaacctctttcccacttttctggagggtaagaacccctgaaccccttccctccgtgtctctactctctcttttctctgggcttgcttccttcactatgggcaaccttccaccctccattccttcttctcccttagcctgtgtttttaagaacttaaaacctcttcaactctcacttgacctaaaatctaagtgtcttattttcttctgcaataccgcttgaccacaatacaaactcaacagtagttccaaatagccagaaaacagcactttcaattttttcatcctgcaagatctaaataattcttgtcataaaataggcaaacggtctgaggtgcctgacgtctaggcattcttttacacatcggtcccttcctagtctctgtgcccagtgcaactcgtcccaaatcttccttctttccctcccacctgtcccctcagtctcaaccccaagcgtccaagcgtggctgagtctttctaaccttccttttctacagacccatctgacctctcccctcctccccagactgctcctcgccaggccaagctaggtcccaattcttcctcagcctccgctcctccaccctataatccttttatcacctcccctccttacacccagtccggcttacagtttcgttccatgactagccctccccaacctgaccagcaatttactcttaaaaaggtggctagagctaaaggcatagtcaaggttaatgctcctttttctttatcccaaatcagatagcgtttaggctgtttttcatcaaatataaaaatccagcccagttcatggtcgctcggcatcaaccctgagaagctttacagccctagaccctaaaaagtcaaaaggctgtcttatactcaatatacattttattacccaatctgctcccgacattaaataaaactccaaaaattaaattctggccctcaaaccccacaacaggatttaattaacctcgccttcaaggtgtacaataatagaaaaaagttgcaattccttgcctccactgtgagacgaaccccagccacatctccagcacacaagaacttccaaatgcctgaactgcagcggccaggccttcctccagaacctcctcctccaggagcttgctacaagtgccagaaatctggccaccaggccagggaattcctgcagcccaggattcctcctaagccacgtcccatctgtgccggaccccactggaaatcggactgttcagctcacctggcagccactcccagagcccctggaactctggcccaaggttctctgactgaccccttctcggcttagtggctgaagactgacactgcccgatcgccttggaagccccctagaccatcacggatgccgagctttaggtaactctcacagtggagggtaagtccatccccttcttaatcaatacggaggctactcactccacatcaccttcttttcaagggcctgtttcccttgcctccataactgttgcaggtattgacggccaggcttctaaacctcttaaaactctccaactctggtgccaacatagacaatactcttttaagcactcctttttagttatccccacctgcccagttcccttattaggctgagacactttaactaaattatctgcttccctgactattcctggactacagctacatctcattgctgcccctcttcccaatccaaagcctcctttgcgtcctcctcttgtatcccccgaccttaacccacaagtataagatacctctactccctccttggcgacggatcatgcgccccttaacatctcattaaaacctaatcacccttacccctctcaatgccaatatcccacctcacagcatgctttgaaaggattaaagcctgttatcacccgcctgctacagcatggccttttaaagcctataaactctccttacaattcccccattttacctgtcctaaaaccagacaagccttacaagttagttcaggatctatgccttatcaaccaaattgttttgcctatccaccccatggtgccaaacccgtatactctcctatcctcaatacctccctccacaatccattattctgttctggatctcaaatatgctttctttactattcctttgcacccgtcatcccagcctctctttgctttcacttggactgaccctgacacccattaggctcagcaaattacctgggctgtacttcaaagcttcacagatagcccccattacttcaatcaagcccaaatttcatcctcatctgttacctatctcagcataattctcataaaaacacatgtgctctccctgctgatcgtgtctgattaatctcccaaacctcaatcccttacaaaacaacaattcctttccttcataggcatggttagtgcggtcagaattcttacacaagagccaggaccacaccctgtagcctttctgtccaaacaacttgaccttactgttttagcctagccatcatgtctccgtgcagcggctgctgcagccctaatactttagaggccctcaaaatcacaaactatgctcaacttactctctacatttctcataatttccaaaatctattttcttcctcatacctgacgcatatactttctgctccacggctccttcagctgtactcactctttgttaagtcccacaattaccattgttcctggcccggacttcaatccagcctcccacattattcctgataccacacctgacacccaagactgtatctctctgatccacctgacattcaccccatttccccatatttccttctttcctgttcctcagcctgatcacgcttgattttttttttttttttttttttttttgagacggagtctcgctctgtcgcccaggccggactgcggactgcagtggcgcaatctcggctcactgcaagctccgcttcccgggttcacgccattctcctgcctcagcctccccagtagctgggactacaggcgcccacgcttgatttattgatggcagttccaccaggcctaatcatcacacaccagcaaaggcaggctatgctacagtacaagccactagcccacctcttagaacctctcattttctttacatcatggaaatctatcctcaaggaaataacttctcagtgttccatctgctattctactactcctcagggattattcaggcccttccctacacatcaagctcaaggatttgcccccacccaggactggcaaattagctttactcaacatgcccctagtcagataactaaaatacctcttagtctaggtagacactttcactggataagtacaggcctttcctacagggtctgagaaggccaccgcagtcatttcttcccttctgtcagacataattcctcagtttagccttctcacctctatacagtctgataacagaccagcctttattagccaaatcagccaagcagtttttcaggctcttagtattcagtgaaacctttatatcccttacggtcctccgtcttcaggaaaagtagaacggactaaaggtcttttaaaaacacacctcaccaagctcagccgccaacttaaaaaggactggacaatacttttaccactttcccttctcagaagtcaggcctgtcctcggaatgctacaaagtacagcccatttgagctcctgtatagacgctcctttttattaggccccagtctcattccagacaccagaccaacttagactgtgccccaaaaaaacttgtcatccctactatcttctgtctagtcatactcctattcaccgttctcaactactcatacatgtcctgctcttgtttacactgccagtttacactgtttctccaagccatcacagctgacatctcctcatgctatccccaaactgccactcttaactcttgaagtaaataaataatctttgctggcaggactatgctgaatctccttaggcactctctaatcagatgtcctgagtcgtcccaatacttagaccttttatacctgtttttctccttctcttattccatttagtttttaattcatacaaaactgtatccaggccatcaccaataattctaaatgacaaatgtttcttctaacaaccccacaatatcaccccttaccacaagacctcccttcagcttaatctctcccactctaggttcccacgccgcccctaatcccgctcgaagcagccctgagaaacatcgcccattatctctccataccatcccccaaaattttcgctgtcccaacactttaccactatttcattttatttttcttattaatataagaagacaggaatgtcaggcctctgagcccaagctaagccatcatatcccctgtgacctgcacgtacacatccagatggccggttcctgccttaactgctgacattccaccacgaaagaagtgaaaatggcctgttcctgccttaactgatgacattgtcttgtgaaattccttctcctggctcatcctggctcaaaagctcccccactgagtaccttgtgacccccactctggcctccagagaacaacccccctttgactgtaattttcctttacctacccaaatcctataaaacagccccacccctatctcccttcgctgactctcttttcggactcagcccacctgcacccaggtgaaataaatagctttattgctcacacaaagcctgtttggtggtctcttcacacggactcacatgaaa

SEQ ID NO: 540 - DNA, 5867 bp, Homo sapiens
gtcaggcctctgagcccaagccaagccatcgcatcccctgtgacttgcacgtatacgcccagatggcctgaagtaactggagaatcacaaaagaagtgaatacactttgccccaccttaactgataacattccaccacaaaagaagtgtaaatggctagtccttgccttaagtgatgacattaccttgtgaaaatccttttcctggctcatcctggctcaaaaggcacccccactgagcaccttgcgacccccactcctgcccgccagagaacaaaccccctttgactgtaattttcctttaccgacccaaatcctataaaatggccccacccttatctcccttcgctgactctcttttcggactcagcccgcctgcacccaggtgaaataaacagccatgttgctcacacaaagcctgtttggtggtctcttcacacggacgtgcatgaaatttagtgccgtgactcggatcgggggacctcccttgggagatcaatcccctgtcctcctgttctttgctccctgagaaagatccacctacaacctcaggtcctcagaccgaccagcccaaggaagatctcaccaattttaaatcaggtaagcggcctcttcttactctcttctccaacctctctcactgtccctccactactttctcctttccactcttcaacctctcccttctcttaatttcaattcctttcattttctgggagagacaaagaagacacgttttatccgtggacccaaaactccggcgccggtcacggactgggaaggcagccttcccttggtgtttaatcatttcacggacacctctctgattattcacccatgtttcaaaggtgtcagaccacgcagggacgcctgccttggtccttcacccttaacagcaagtcccgcttttctggggaaggggcaagtaccccaaccccttctctccttgtctctaccccttctctgcttttctaggggaagggcaagtacccctcaaccccttctccttcactcttagcggcaagtcccacttttctacaggaggggcaagtaccccaacctcgtatctctgcgccccaatcccttatttccatgccccgacctcttatctcggcgccccaatcccttatttccatgccccgaccccttatttccgtgccccgaccccttatttctgtgtcccgaccccttatttctgagccccatcccttatttccacaccccaacctcttatctctgcaccccaaccccttttcccacttttctggaaggtaagaacccctgaaccccttccctccatttctctgctctctcttttctctaggcttgcttccctcactatgggcaatctttcaccctccattccttcttctactcccttggcctgtgttctcaaaaacttaaaacctcttccattcacacctgacctaaaacctaaatgccttattttcttctgcaatgccgcttgaccccagtacaaattcgacagtcgttccaaatagccagaaaatggcactttgaatttttccatcctgcaagatctaaataattcttgtcatgaaataggcaaacggtctgaggtgcctgacgtccaggcattcttttacacatcagtcccttcctagtctctgtgcccagtgcaactcgtcccaaatcttccttctttccctcctgtctatcccctcagtaccaaccccaagcgttgctgagtctttctaatcttccttttctacagacccatctgacctctcctttcctctccaggctgctccttgccaggccgagctagatcccaattcttcctcagcctctgctcctccaccctataatctttttatcacctcccctcctcacacctggtccggctttcagtttcgttccgtgactagccctccccctcctgcccagcaatttactcttaaaaaggtggctggagctaaatgcatagtcaaggttaatgctcctttttctttatcccaaatcggatagcgtttaggatcttttttatcaaatataaaaatccagcccagttcatgacttgtttggcagcaaccctgagacactttacagccctagaccctaaaaggtcaaaaggccatcttattctcaaaatacgttttgttacccaatctgctcccgacattaaataaaactccaaaaattaaattctggccctcaaaccccacaacaggatttaattaacctcgccttcaaggtgtacaataatagaaaaaagttgcaattccttgcctccactgtgagacaaaccccagccacatctccagcacacaagaacttccaaatgcctgaactgcagcggccaggcgttcctccagaacctcctcccacaggagcttgctacatgtgccagaaatctggccactgggccaaggaatgcccgcagcccgggattcctcctaagctgtgtcccatctgtgtgagaccccactgaaaattggactgttcaactcacctggcagccactcccagagcccctggaactctggcccaaggctctctgaccaactccttcccagatcttctcggcttagcggctgaagactgacactgcccgatcgcctcggaagccccctagaccatcaccgacgccgagctttgggtaactctcacagtggaaggcaagcccgtccccttcttaatcagcacggaggctacccactccacattactttcttttcaagggcctgtttcccttgcctccataactgttgtgggtattgatggccaggcttctaaacctcttaaaactccccaactctggtgccaacttggacaatactcttttaagcactcctttttagttatccccacctgcccagttcccttattaggctgagacactttaactaaattatctgcttccctgactattcctggactacagctatatctcattgccacccttcttcacaatctaaagcctcctttgcatcctcctcttgtatccccccaccttaacccacaagtatgagatacctctactccctccttggcgaccgatcatgcacccctcaccatctcattaaaacctaatcacccttaccccactcaaggccaatatcccatcccgcagcacgctttaaaaagatttaaagcctgttatcactcgcctgctacagcatggccttttaaagcctataaactctcctgacaatgcccccattttacctgtcctaaaaccagacaagccttacaagttagttcaggatctgcgccttatcaaccaaattgttttgcctatccaccccgtggtgccaaacccatatactctcctatcctcaatacctgcctctacaacccattattctgttctaggtctcaaacatgctttctttactattgctttgtacccttcatcccagcctctcttcgctttcactaggactgaccctgacacccatcaagctcagcaaattacctaggctgtactgctgcaaagcttcacagacagcccccattacttcaatcaagcccaagtttcttcctcatctgttacctatctcggcataattctcataaaaacacacatgctctccctgccaatcttgtctgactgatctctcaaaccccagcaccttctacaaaacaacaactcctttccttcctaggcatggttagtgtggtcagaattcttacacaagagccaggaccacaccctgtagcctttctgtccaacttgaccttactgttttagcctagccctcatgtctgcgtgcagcggctgccactgctttaatacttatagaggccctcaaagtcacaaactatgctcaactcactctctacagttctcataacttccaaaatctattttcttcctcatacctgatgcatatactttctgcttcctggctccttcagctatactcactttttcttgactctcccacaattaccgttgttcctggcccagacttgaatccggcctcccacattattactgataccacacctgacccccatgactgtatctctctgatccacctgacattcaccccatttccccaaatttccttctttcctgttcctcaccctgatcacgcttgatttattgacggcggttccaccaggcctaatcgccacacaccagcaaagacaggttatgctatagtacaagccactagcccgcctcttagaacctctcatttcctttccatcgtggaaatctatcctcaaggaaataacttctcagtgttccatctgctattctactactcctcagggataattcaggccctctcccttccctacacatcaagctcgaggatttgcccccacccaggactggcagattagctttactcaacatgtcccgagtcagggaactaaaatacctcttagtctgaatagacactttcactgaataagtaaaggcctttcctacagggtctgagaaggccaccacagtcatttcttcccttctgtcagacataattcctcagtttagccttcccacctctgtacagtctgataacagaccagcctttattagtcaaatcagccaagcagtttttcaggctcttagtattcagtgaaaactttatatcctttacggtcctccatcttcaagaaaagtagaacggactaaaggtcttttaaaaacacacctcaccaagctcagccaccaacttaaaaaggactggacaatacttttaccactttcgcatctcagaattcaggcctgtcctcagaatgctacaaggtacaccccatttaagttcctgtatagacgctcctttttattaggccccagtctcattccagacaccagaccaacttagactgtgccccaaaaaacttgtcatccctactatcttctgtctagtcatactcctattcacggttctcaactactcatacatgccctgctcttgtttacactgtttctccaagccatcacagctgatatctcctggtgctatccccaaaccgccactctaaactcttgaagtaaataaataatctttgctggcaggactttgctgaaaccccttaggcactctctaatcagatgtcctgggtcctcccaattcttagaccttttatacctgtttttcttctcttattccatttagtttttcaattcatacaaaactgtatccaggccatcaccaatcattctacatgacaaagtttcttctaacgaccccacagtatcaccccttaccacaaaatcttccttcagcttaatctctcccactctaggttcccacgccacccctcaccctgctcgaagcagccctgagaaacatcggccattctctgtctctccataccacccccaaaaagttttcgccgccccaacaattcaacactattttgttttatttttcttattaatataagaaggcaggaatgtcgggcctctgagtccaagccaagccatcgcatcccctgtgacttgcacgtatacgcccagatggcctgaagtaactgaagaatcacaaaagaagtgaatatgccctgccccaccttaactgatgacattccaccacaaaagaagtgtaaatacttcttttgtcttaagtttgtcttaagttttgactaacttaaggtccttgccttaagtgatgacattaccttgtgaaagtccttttcctggctcatcctggctcaaaaagcacccccactgagcaccttgcgacccccactcctgcccgccagagaacaaaccccctttgactgtaattttcctttacctacccaaatcctataaaacggccccacccttatctcccttcgctgactctcttttcggactcagcccgcctgcacccaggtgaaataaacagccatgttgctcacacaaagcctgtttggtggtctcttcacatggacgcgcatgaaa

SEQ ID NO: 541 - DNA, 695 bp, Homo sapiens
ttacagtaggcagtcaggcagacataagcaggacaggaggacacccccaaccaggaatggccacatcaggtgatgatcaggtggttgttaaactgtctctctaaaataataattggtcacacctggtgccaggaaaaggcagtctaccactagatagaaaagcctgaaactggtgatcagcagcttcccaataagactcaggagttaggcaagtgggctcaagcatgcacactaagaggcaaaatggtggagtttaactggtggcatatgaccttcttctaggagcactcaaccagtcagggaagaatgcctcaaatgagcacgtgtacaacttcagtaaacacactgtgcatgcagcccctcccaagtgctggtaggtcactgtgcatgtggacagcccaccccaagggaagaatcagagaagggatgcaaccccacagaagcatgccaagtcaaaggttaaacaccaagtcaaaggttaaatcatacacttgaatctctcaagtcacccacttagcccaattccaagtgtactttgcttccttttattcctgttctaaagctttttaacaaactttcactcctgttctaaaacttgcctcagtctctccctgtcttatgccccttggtctaattctttattctgaggaggcaagaattgaggctgctgcaaacacatatggattcggcgctgc

SEQ ID NO: 542 - DNA, 566 bp, Homo sapiens
aattgaaactgtaaaactacaaatggttcttcaaatggagccccagatgcagtccatgactaagatccaccacggactcctggaccggcctgctagcccatgctctgatgttaatgacatcgaaggcacccctcccaaggaaatctcaactgcacaactcctactatgccccagttcagcaggaagcagttagagccgtcatcggccaacttccccaacagcatttgggttttcctgttgagacgggggactgagagacaggactagctggatttcccagtccctaagcctagctgggaaggtgaccacatccacctttaaacatggggcttgcaacttagctcacacccaaccaatcagagagctcactaaaatgctaattaggcaaaaacaggaggtaaagaagtagccaatcatctattgcctgggagcacagcgggagggacaaggatcgggatataaacccaggcattcgagccggcaacggcaaccccctttgggtcccctgcctttgtatgggagctctgttttcactctatttcactctattaaatcttgcaactgca

SEQ ID NO: 543 - DNA, 383 bp, Homo sapiens
gtcagccctctgagcccaagctaagccatcatatcccctgtgacctgcacatatatatccagatgcctgaaataactgaagaatcacaaaagaagtgaaaatgcctgttcctgccttacctgatgacattgccttgtgaaattccttctcctggctcagaagctcccccactgagcaccttgtgaaccccaccccagcccaccagagaactaccccctttgactgtaattttccattaactacccaaatctataaaacagccccacccctatctcccttcgctgactcttttccgactcagccccgctgtatccaggtgaaataaacagccctgttgctaacacaaagcctgtttggtggtctctttacacggacatgtgtga

SEQ ID NO: 544 - DNA, 435 bp, Homo sapiens
gtcaggcctctgagccgaagccaagccatcagactccctgtgacctgcacgtatacatccagatggcctgaagcaactgaagaacaacaagaagaagcgaaaatagctagttcctgccttaactgatgacattccaccattgtgatttgttcctgccccaacctaactgatcaattgaccttgtgacattccttctcctggacaatgaatctcaggagctccccactgagcaccttgtgatccccgcccctgcccgcaagagaacaacctcctttaactgtaattttccactatctacccaaatcctataaaactgcccgacccctatctccctttgctgactccttttctgaactcagtctgcctgcacccaggtgattaaaagctttattgctcatacaaagcctgtttggtggtctcttcacatggacgcac

SEQ ID NO: 545 - DNA, 160 bp, Homo sapiens
tgaaatgtgtccaaaatgtaaaaaaggaaaacattgagctagtcagtgtcactctaagtttgataaagatgggaacccaatttcaggaaatgccatgaggtgccagcccatcccggcccccactccagactggggcatttccagctcaggccattccttc

SEQ ID NO: 546 - DNA, 519 bp, Homo sapiens
actaagagctaccatggacccctggactagcctgctagctcgtgctctgatgtcaatgacatcaaaggcatccctcccaaggaaatctcaactgcacaacccctactatgccccaattcagcaggaagcagttagagtggtcgtcggccaatctccccaacagcacttgggttttcctgttgagagggggcaccgagagacaggactagttggatttcctaggctgcctaagaatccctaagcctagctgggaaggtgaccacatccacctttaaacatggagcttgcaacttagctcacacctgaacaatcaggtagtaaagagagctcactaaaatgctaattaggcaaaaacaggaggtgaagaaatagccaatcatctattgcctgagagcagaccaggaggaacaattatcaggatataaacccaagcattcgagccagcaacggctaccctctttgggtcccctccctttgtatgggagctctgttttcactctattaaatcttgcaactgca

SEQ ID NO: 547 - DNA, 770 bp, Homo sapiens
gagagacaggactagctggatttcctaggcggactaagaattcttaagcctagctggggaaggtgaccgcaccgccctttaaatacggggcttgtaactcagctcacacccaaccaatcaggtagtaaagagagctcactgaaataccaattaggctaaaaacaggagataaagaaataatcaaatcatctatcacctgagagcacagggggaggaacaatgattgggatataaaccccaggcattcgagctgggagtgggcagcccccttggggtcccctctcattgtataggagctctgttttcactctattaaatcttgcaactgcaccctcttctggtccgtgtttgttctggctggagctgagctttcgcacactgttccaccactgctgaatgccactgtcacagacctgccgctaacttatactcctctggatacggcagggtgtccgctgccctcctgatccagcgaggcatccattgcggctccctatcgggctaaaggctcgccattgttcctacacagctaaatgcccgggttcgtcctaatcaacctgaatactagttgctgggttccacggttctcttccgtgacccacggcttctaatagagttataacactcaccacatgccccaaggttccattccttggaatccgtgaggccaagaaccccaggtcagagaacaaaaagcaccccgccaccatcttgggagcggcctgccaccatcttgggagcttgaagaacaaagacccgcctgtaacatt

SEQ ID NO: 548 - DNA, 5651 bp, Homo sapiens
gtcaggcctctgagcctaagctaagccatcatatcccctgtgacctgcatgtacacatccagatggccggttcctgccttaactgatgacattccaccacaaaagtgaaaatggcctgttcctgccttaactgatgacattatcttgtgaaattccttctcctggctcatcctggctcaaaagctcccctactgagcacctgtgacccccactcctgcccaccagagaacaacctccctttgactgtaattttcctttacctatccaaatcttataaaatggccccacccccatctcccattgctgactctcttttcagactcagcccacctgcacccaggtgaaataagcagccttgttgctcacacaaagcctgtttgatggtctcttcacatggatgttagtgaaatttggtgccgtgactcagattgggggacctcccttgggagatcgatcccctgtcctcctgctctttgttccatgagaaagatccacctacgacctctggccctcagaccaaccagcccaaggaacatctcaccaattttaaatccggtaagcggcctctttttactctcttctccaacctctctcactatccctcaacctctttctcctttcagtcttggcaccacacttcaatctctcccttttcttaatttcagttcctttctttttctggtagagacgaaggagacgcttttatccgtggacccaaaactccggtgccagtcatggactcatgaagacagtcttcccttggtgtttaatcatgtggggatgcctgcctgattattaacctacgtttcagaggtgtctgaccacacagggacgcctgccttggtccttcacccttagcggcaagtactgcttttctggggggcaagaacccccaaccccttctacttcacccttagtggcaagtaccacttttctggggggcaagaatcccccagcccctactctccgtgtctctaccccttctctgcttttctgggtggcaagaaccccccaccccttctctccatgtctctactctctcttttctgtgggcttgccttgttcactatgggcaagcttctgccctccattcccccttcttctcccttagcctgtgttcttaaaaatctaaaacctcttcaactcacacctgacctaaaacctaaatgccttattttcttctgcaatgccgcttgaccccagtacaaactcaacagtagttccaaatagccagaaaatggcactttcaatttttcctacaagatctgaataattcttgtcgtaaaatgggcaaatggttggaggtgcctgacgtccaggcattcttttacacatcggtccctccctagtctgttcccaatgcaactcatcccaaatcttccttttttccctcccgcctgtcccctcagtcccacccccaaagcgtcgctgagtctttctaatcttccttttctacagacccatctgacctctcccctcctcaccaggccaagctaggtcccaattcttcctcagcctctgctcctccaccctataatccttttatcacctcccctcctcacacccggtctggcttacagtttccttctgtgactagccctcccccacctgcccagcaatttcctcttagaaaggtggctggagttaaggcatagtcaaggttaatgctcctttttctttatcccaaatcagatagcgtttaggctctttttcgtcaagtataaaaacccagcccggttcatggcttgtttggcagcaaccctgagatgctttacagtgctagaccccaaaacctcaaaaggccaaaaggccatcttatcctcaatatacattttattacccaatctgctcccgacattaaataaaactccaaaaattaaattccagccctcaaaccccacaacaggacttaattaacctcaccttcaaggtgtacaataatagaaaaaagttgcagttccttacctccactgtgagacaaaccccagccacatctccagcacacaagaacttccaaaagcctgaaccacagtggccaggcattcctccagaacaccaggatcttgctacaagtgccagaaatctggccaccaggccaaggaatgcctgcagcctgggattcctcctaagccatgtcccatctgtgcgggaccccactggaaatcggactgtccaactcacccagcagccactcccagagtacctggaactctggcccaaggctctctgactgactccttcccagatcttctcggcttagcagctgaagactgacactgccgtatcgcctcagaagcctacaggaccatcacaggtgctctgggtaactctcgcagtggagggtaagtccatccccttcttagtcaatacagaggctacccactccacattacctgcttttcaaggacctgtttcccttgcctccataactgttgtgggtactgacagccaggcttctaaacctcttaaaactgcccaactctggtaccaacttagacaatactcttttaagcactcctttttagttatccccacctacccatttgccttattaggctgagacactttaactaaattatctgcttccctgactattcctgggctatagccacacctcattgccgccttttcccccagctcaaagcctccttcacatcctccccttgtatctccccaccttaacccacaagtataggacacctctactccctccttagcgactgatcatgcaccccttaccatcccattaaaacctaatcacccttaccctgctcaatgccaatatcccatcccacagcatgctttaaaaggattaaagtctgttatcactcacctgctacagcatggcattttaaagcctataaactccccttacaattcccccattttacctgtcctaaaaccagacaaggcttacaggttagttcaggatctgcgccttatcaaccaaattgttttgcctatccagcccatggtgccaaacccatatactctcctatcctcaatacctcactccacaacccattattctattctggatctcaaacatgctttctttaccattcctttgcacccttcatcccagcctctctttgctttcacttggactgaccctgacacccatcaggctcatcaaattacctgggctgtactgctgcaaagcttcgcagacagcgcccattactttagtcaagcccaaatttcttcctcatctgttacctatctcagcataattctcataaaaaacacacgtgctctccctgccgatcatgtccaactgatctctcaaaccccagcgccttctacaaaacaacaactcctttccttcctaggcatggttggatacttttgactttagatacctggttttgccatcctaacaaaaccattatataaactcacaaaaggaacccggctgaccccatagatcctaaatcctttccccatcctctttccattccttgaagacagctttagagactgcccccatcctagctctccctgactcatcccaacccttttcattacccacagccaaagtgcagggctgtgcaattggaattcttacacaagaaccaggactgtgccctgtagcctttttatccaaacaacttgaccttactgttttgcctagctctcaagtctgtgtgcggtggccaccactgccctaatacttttagaggcccttaaaatcacaaactatgctcaactcactctctacagttctcataacttccaaaatctattttcttcatcacacctgacacatataatttctgctctccagctccttcagctgtactcactctttgttgagtctcccacaattaccattattcctggcctggacttcaatccggcctcccacattattcctgataccacacctgaccctcatgactgtatctctctgatccacctgacattctccccatttccccatatttccttctttcctgttcctcaccccgatcacacttggtttattgatggcagttccaccaggcctaatcaccacacaccagcaaaggcaggctatgctatagtacaagccactagcctgcctcttggaacctctcatttcctttctgttgtggaaatctatcctcaaggaaataacttctcagtgttccatctgctattctactacttctcagggattattcaggccccctcccttcactacgcattaagcttggggatttgcccctgcccaggactggcaaattgactttactcaacatgccctgagtcaggaaactaaaatacctcttggtctaggtagacactttcactggataggtagaggcctttcccacagggtctaagaaggccatcacagtcatttcttcccttctgtcagacataattcctcagtttggccttcccacatttatacagtcctataacagactggcctttattagtcaaatcacccaagcagtttctcaggctcttagtattcagtgaactaatagtctttgaaaaacacaccacaccaagctcagccaccaacttaaaaatgactggacaatacttttaccacctgcccttctgagaattcaggcctgtcctcagaatgctacaaggtacagcccatttaagctcctctatagacactcctttttattaggccccagtctcattccagacaccagaccaacttagactgtgctccaaaaaacttgtcatccctattatcttctgtctagtcatcctcctattcactgttctcaactactcatacacgccctgctcttgtttacactgctggtttacactgtttctccaagccatcacagctgatgtctcctggtgctatccccgaaccgccacgcttaactcttaaagtaaataaataatctttgctggcaagcctatgctgaacctccttaggcattctctaattagatgtcctaggtcctcccaattcttagtcctttaagacctgtttttctccttcttttattccatttagtttttcaattcatgcaaaactgtatccaggccatcaccaataattctacaagacaaatgtttcttctaacaaccccacaatatcaccccttaccacaaaatcttccttcagcttaatctctcccactgtaggttcccacgccacccctaatccccctcaaagcagccccaagaaacatcgcccattatttctccataccaccccccaaaattttcaccatcccaacactttaccactattttatttttcttattaatataagaagacaggaatgtcaggcctctgagcccaagctaagccatcatatcccctgtgacctgcgcgcacacatccagatggcgggttcctgccttaactgatgacattccaccacaaaagaagtgaaaatggcctgttcctaccttaactgatgacattgtcttgtgaaattccttctcctggctcaaaaggtcccctactgagcacctgtgacccccactcctgcccaccagagaacaacccccctttgactgtaattttcctttacctacccaaatcttataaaatggccccacccctatctcccttcactgtctcttttcagactcagcccgcctgcaccccggtgaaataaatagccttgttgctcacacaaaggctgtttggtggtctcttcacacggacacaagtgaaa

SEQ ID NO: 549 - DNA, 3746 bp, Homo sapiens
gtcaggcctctgagcccaagctaagccatcatatcccctgtgacctgcacatacacatccagatggccggttcctgccttaactgatgacattccaccacaaaagaagtgaaaatggcctgttcctgccttaactgatgacattatcttgtgaaattccttctcctggctcatcctggctcaaaagctcccctgctgagcaccttgtgacacccccacccactcctgcccgccagagaacaaccccctttgactgtaattttcctttacctacccaaatcttataaaacggcctcacccctatctccctttgctgactctcttttcggactcagcccgcctgcacccaggtgaaataaacagccttgttgctcacacaaagcctgtttggtggtttcttcacagggatgtgcatgaaatttggtgccatgattcagaccccactggaaatcggactgttcaactcacctggcagccactcccagagcccctggaactctggcccaaggctctctgactgactccttcccagatcttctcggcttagcagctgaagactgacattgcccgatcacctcggaagcctacaggaccatcacggatgctgtgagtaactctcacagtggacggtaagtccgtccccttcttaatcaatatggagactacccactccacattaccttcttttcaaaggcctgtttcccttgcctccataactgttgtaggtactgacggccaggcttctaaacctcttaaaactctccaactctggtgccaacttaggcaatacttttttaagccctcctttttagttatccccacctgcccagtccccttattcagctgagacactttaactaaattatctgcttccctcactattcctggactgcagccacatctcatcgccgcccttcttcccaatccaaagcctcctttccatcctcctcttgtatccccctaccttaacccagaagtatggaatacctctactccctccttggcgaccaatcatgcaccccttaccatctcattaaaacctaacacccttaccccgctcaatgccaatatcccatcctgcagcacactttaaaaagattaaagcctgttatcacttgcctgttacagcatggccttttaaagcctgtaaactctccttaaaattcccccattttacctgtccaaaaactggacaagtctcacaggttagttcaggatctgcgccttatcaactaaattgttttgcctatccactccatagcgccaagcccatatactctcttatcctcaatacctccctttacaatccattattctgttctggatctcaaacatgctttctttactattcctttgcacccttcaccacagcctctcttcactttcacttggactaaccctgacacccatcaggctctgcaaattacctaggctgtactgccacaaggcttcacagacagcccccattacttcagtcaagcccatatttcatcctcatctgttacctatctcagcataattctcataaaaacacaggtgctctccctgctgatcgtgttagactaatctcccaaacctcaatcccttctacaaaacaactcctttccttcctaggcatggttagtgcagtcagaattcttacacaagaactgagaccacaccctgtagcctttctgtccaaacaactttaccttactgctttagcctagccctcatgtctgcatgcagtggctgccactgctttaatagttttagaagccctaaaaatcacaaactatgctcaactcactctctacagttctcataacttccaaaatctattttcttcctcatacctgatgcatatactttctgcttcccagctccttcagctgtactcactctttgttgagtctcccacgattaccattgttcccagcacggacttcaatctggcctcccacattattctggataccacacctgaccctcgtgactgtatctctgtgatccacctgatgttcaccccatttccccatatttccttatttcctgttcctcacactgatcacatttagtttattgatggcagttccaccaggcctaatagccactcactagcaaaggcaggctatgctatagtacaagccactagcccacctcttagaacctctcatttcctttccatcgtagaaatctatcctcaaagaaataacttatcagtgttccatctgctattctactacttctcaaggattattcaggccccctcccttccctacacatcaagctcaaggatttgcccccacccaggactggcaaattgactttactcaacatgccccaagtcaggaaactaaaatacctcctagtctaagtagacagtttcactggataaatagaggcctttcccacaaagtctaagaaggccaccatggtcatttcttcccttctgccagacataattcctttgtttggccttcccacctctacacagtctgatagcagaccagcctttattagtcaaatcagccaagcattttttcaggctcttagtattcagtgaaacttgtatatcccttacagtcctcagtcttcaggaaaggtagaacggactaatagtcttttaaaaacacaccttaccaagctcagccaccaacttaaaaaggactagagaatacttttaccactttcccctctaagaattcaggcctgttctcagaatgctacaaggtgaacaggagcccatttgatctcctgtatagatgctctttttattaggccccagtctcatcccagacaccagatcaacttggactgtgccccaaaacttgtcatccctactattttctgtctaatcatactcctattcaccattctcaactactcatacatgccctgctcttgtttacactgccggtttacactgtttctccaagccatcacagctgatatctcctgctgctatccccaaaccgccactcttaactcttaaagtaaataaataatatttgcttgcaaggctatgctgaacctccttcagcactctctaattagatgtcctaagtcctcccaattcttagtcctttaatacctgtttttctccttctcttattccgtttagtttttcagttcatacaaaaccgtatccaggccatcagcaataattctacatgacaaatatttcttctaacaaccccacaatatcatcccttaccacaaaatcttccttcagcttaatctttcccactctaggttcccacaccgcccctaatacccctcgaagcaaccctgagaaacaacgtccattatctctccataccacacccaaaaatttttcgccgtcccaacactttaccactatttcgttttatttttcttattaattataagaagacaggaatgtcaggcctctgagctcaagctaagccatcatatcccccgtgacctgcacatacatatccagatggctggttcctgccttaactgatgacattatcttgtgaaattccttctcctggctcatcctggctcaaaagctcccctgctgagcaccttgtgaccccctccccgcccctgcccgccagagaacaaccccctgtgactgtaattttcctttacctacccaaatcttataaaatggcctcacccctatctccctttgctgactcttttcggactcagcccgcctgcacccaggtgaaataaacagccttgttgctcacacaaagcctgtttggtggtctcttcacatagccacgcgtgaaa

SEQ ID NO: 550 - DNA, 5809 bp, Homo sapiens
gtcaggcctctgagcccaagccaagccatcgtatcccctgtgacctgcacctgtacgcccagatggcctgaagtaactaaagaatcacaaaagaagtgaatatgccctgccccaccttaactgatgacattccaccacaaaagaagtgtaaatggccagtccttgccttaactgatgacattaccttgtgaaagtccttttcctggctcatcctggctccaaaagcacccccactgagcaccttgcgacccccactcctgcccactgagcaccttgcaacccccactcctacccgccagagaacaaacccccttggactgtaattttcctttacctacccaaatcctataaaacggcctcacccttatctcccttcactgacccttttcggactcagcctgcctgcacccaggtgaagtgagcaacagccatgttgctcacacaaagcctgtttggtggtctcttcacatggacgcgcatgaaatttggtgccgtgactcggatcgggggacctcccttgggagatcaatcccctgtcctcctgctctttgctccgtgagaaagatccacctacgacctcaggtcttcagaccgaccagcccaagaaacatctcaccaatttcaaatccggtaagcggcctctttttactctcttctccaacctccctcactatccctcaacctctttctcctttcaatcttggcgccacacttcaatctctcccttctcttaatttcaattcctttcattttctggtagagacaaaagagacatgttttatccgtgaacccaaaactccggcgccagtcacggactgggaaggcagccttcccttggtatttaatcattgcagggacgcctctctgattatacactcacgtttcaagggtgtcagaccacgcagggacgcctgccttggtccttcacccttagcggcaagtcccgctttcctggggcaggggcaagtacccctcaaccccttctccttcacccttagcggcaagtcccgctttcctagggggcaagaaccccccaatcacttatttccacaccccaacctcttatctctgtgccccaatcgcgtatttccacaccccaacctcttatctctgcaccccaatcccttatttccgcaccctgacctcttatctctgtgccccaatcccttatttccgtgtcccagccctttctctgcttttctggaggggaagaaacccccaccccttctccgtgcctctactcttttctctgggcttgcctccttcactatgggcaagcttccaccttccattcctctttcttctcccttagcctgtattcttaagaacttaaaacctcttcaattctcacctgacctaaaatctaagagtcttattttcttctgcaatgccgcttgaccccaatacaaactcaagagtagttccaaatagccagaaaacggcactttcaatttttccaccctacaagatctaaataattcttgtcgtaaaatgggcaaatggtctgaggtgcctgaagtccaggcattcttttacacatcagttccttcctagcctctgtgcccagtgcaactcgtcccaaatcttccttctttccctccctcctgtcccctcagtaccgaccccaagcgtcgctgagtctttctaatcttccttttctacagacccatctgacctctcccctcctcgacaggccaagctaggccccaattcttcctcagcctccgctcctccaccctgtaatctttttattgcctcccctcctcacacctggtctggcttacagtttccttctgtgactagccctccccgacctgcccagcaatttactcttaaaaaggtggctggagccaaaggcatagtcaaggttaatgctcctttttctttatcccaaatcagatagcgtttaggctctttttcatcaaatataaaaatccagcccagttcatggctcgtttggcagcaaccctgagacactttacagccctagcccctaaaaggtcaaaaggccgtcttattctcaatatacattttattacccaatctgctcccgacattaaataaaactccaaaaactagaatctggccctcaaaccccacaacaggacttaattaacctcaccttcaaggtgtgcaataacagaaaaaagttgcaattccttgcctccactgtgagacaaacctcagccacatctccagcacacaagaacttccaaacgcctgaactgtagcagccaggcgttcctccagaacctcctcccccaggaacttgctacacatgccggaaatctggccactgggccaaggaacacccgcagcccaggattcctcctaagccacgtcccatctgtgtgggaccccactgaaaattggactgttcaactcacctggcagccactcccagagctcctggaactctggcccaaggctctctgactgactccttcttggcttaccggctgaagactgacactgcccgattgcctcggaagccccctagaccatcacggacgccgagcttcgggtaactctcacagtggaaggtaagcccgtccccttcttaatcaatacggaggctactcactccacattacgttcttttcaagggtctgtttcccttgcctccataactgttgtgggtattgatggccaggcttctaaacctcttaaaactccccatctggtgccaacttagacaatactcttttaagcactcctttttagttgtccccacctgcccagttcccttattaggctgagacactttaactaaattatctgcttccctgactattcctggactacagctatatctcattgctgctcttcttcccaatccaaagcctcctttgggtcctcctcttgtatcccccaaccttaacccacaagtataagatacctctactccctccttggcgaccaatcatgcaccccttaccatctcattaaaacctaatcacccttaccccactcaacgccaatatcccatcccacagcacactttaaaaagattaaagcctgttatcactcgcctgctacagcatggccttttaaagcctataaactctccttacaattcccccattttacctgtcctaaaaccagacaagccttacaagtttgttcaggatctgcgcctcatcaaccaaattgttttgcctatccaccccgtggtgccaaacccatatactctcctatcctcaatacctgcctctacaacccattattctgttctagatctcaaacatgctttctttgctattcctttgcacccttaatcccagcctctcttcgctttcacttggactgaccctgacacccatcaagctcatcaaattacctaggctgtactgccgcaaagcttcacagacagcccccattacttcaatcaagcccaaatttcttcctcatctgttacctatcttggcataattctcataaaaacacacgtgctctccctgccaatcgtgtccgactgatctctcaaacccaagcaccttctacaaaacaacaactcctttccttcctaggcatggttagcgaggtcagaattcttacacaagagccaggaccacaccctgtagcctttctgtccaaacaacttgaccttactgttttagcctagccctcatgtctgcatgcagctgctgccgctgcattaatacttttagaggccctcaaaatcacaaactatgctcaactcactctctacagttctcataacttccaaaatctattttcttcctcatacctgatgcatatactttctgcttcccggctccttcagctataccccactctttgttgagtctcccacaattaccgttgttcctggcccagacttcaatcctacctcccacattattcctgataccacacctgacccccatgactgtatctctctgatccacctgacattaaccccatttccccaaatttctttctttcctgttcctcaccctgatcacgcttgatttattgatggcagttccaccaggcctaatcgccacacaccagcaaaggcagatgatgctatagtacaagccactagcccgcctcttagaacctctcatttcctttccatcatggaaatctatcctcaaagaaataacttctcagtgttccatctgctattctgctcagtgttccatctgctattctactactcctcagggattattcaggccccctcccttccctacacatcaagctcgaggatttgccccacccaggactggcaaattagctttactcaacatgcccttagtcagataactaaaatacctcttagtctaggtagataatttcactggataggtagaggcctttcctacagggtgtgtacagggtgtgagaaggccaccgcagtcatttattcccttctgtcagacataattcctcagtttagccttcccacctcaatacagtctgataacagacgagcctttatcagtcaaatcagccaagcagtttttcaggctcttagtattcagtgaaacctttatatcccttacggtcctctgtcttcaagcaaagtagaatggactaaaggtcttttaaaaacacacctcaccaagctcagccaccaacttaaaaaggactggacaatacttttaccactttcccttctcagaattcaggcctgtcttcagaatgctacagggtacagcccatttaagctcctgtatagacgctcctttttattaggctccagtctcattccagacaccagaccaacttagactgtgccccaaaaaacctgtcatccctactatcttctgtctagtcatactcctattcaccgttctcaactactcatacatgccctgctcttgtttacactgctggtttacactgtttttccaagccatcacaactgatatctcctggtgctatccccaaactgccactcttaactcttgaagtaaatacataatctttgctggcaggactatgctgaatctccttaggcactctctaatcagatatcctgagtcgtcccaattcttagaccttttatacctgtttttctccttctgttattccatttagtttctcaattcatccaaaaccgtatccaggccatcaccaatcattctatacgacaaatgtttcttctaacatccccacaatatcaccccttaccacaagacctcccttcagcttaacctctcccactctaggttcccacgccgcccctaatcccgcttgaagcagccctgagaaacatcgaccattctctctccataccacccccaaaaaattttcaccgccccaacacttcaacactattttgttttatttttcttattaagaaggcaggaatgtcaggcctctgggcccaagccaagccatcacatcccctgtgacctgcacctataagcccagatggcctgaagtaactaaagaatcacaaaagaagtgaatatgccctgccccaccttaactgatgacattccaccacaaaagaagtgtaaatggccggtccttgccttaactgatgacattaccttgtgaaagtccttttcctggctcatcctggctccaaaagcatccccactgagcaccttgcgacccccactcctgcccactgagcaccttgcaacccccactcctacccgccagagaacaaacccccttggactgtaattttcctttacctacccaaatcctataaaacggccccacccttatctcccttcgctgactctcttttcgaactcagcccgcctgcaaccaggtgaaataaacagccatgttgctcacacaaagcctgtttggtggtctcttcacacggacgcacatgaaa

SEQ ID NO: 551 - DNA, 6896 bp, Homo sapiens
gtcaggtctctgagcacaagctaagccattataacccctgtgacctgcacgtatacatccagatggcctggagcaagtgaagaaccacaaaagatgacattccaccattgtgatttcttcctaccccagcccaactaataaatcaaccttgtgacatttctcccctggacaatgagtcttaggatttccccaccctgcacctggtgacccccacccctgcccgcaagagataaccacttttaactgtaattgtccactacctacccaaatcctataaaactgccccacccctatctccctttgttgactcattttttggcctcagcctgcctgcacccaggtgaaataaacagctttattgcttacacaaagcctgtttggtgatctcttcacatggacgtgcgtgaaaacttggtgccgaagacccaggacaggaggactgcttcgggagactggtcccctgtcctcaccctcactccgtgaggagatccacctacgacctcaggtcctcagaccaaccaacccaaggaacatctcatgaatttcaagtcgggtaagcggtcttttcactctcttctctagcctctctcactacccttcaatctccctgtccttccaattccagttctttttcctctctagtagagacaaaagagacacattttatccgtggacccaaaactccggtgctggtcacggactcgggaagacagtgttcccttggtgtttaatcactgtggggacgcctgcctgattattcacccacatttcagaggtgtctgatcaccacggggacacctgcgttgatccttcaccttggtggcaagtaccacctctccttggcggcaagtaccacctaccctgggtggcaagtaccacctcctctgggcgggaagtaccacccccctctctccgtgtctctaccctctcttttctctaaacttaccgttttattgtgggcaaccttcctccctccattcctccttctcccttagcctgtgttctaaaaaacttaaaaccccttcaactcacaactgacctaaaacctaaatgccttattttcttctgcaatactgctaggccccaatacaaacttgaaaatggctctaaatggccagaaaatggcactttcagtttctccatcctacaagagctagataatttttgtcgaaaaatgggcaaatggtctgaggtgcctgacgtccaggcattcttttacacatcggtccctccctagcctctgctcctaatgcaactcatcccaaatctttcttctttttctcctgtctgttccttcagtctccaccccaagctgtgggtcctttgaatcctccttttctatgaacccatctgacctctcccctctttcccaggctgctcctttcgaggtcccaattcttcctcagcctccgctcccccaccctataatccttctatcacctcctctcctcacacccggtccagcttacagttttgttctgcgactagccctccccagcctgcccaacaatttcctcttagagaggtgactagagctgaaggcacagtcaaggttaatgctcctttttcttcatccgacctctcccaaatcagttagtgtttaggctttttttaatcaaatatgaaaacccagcccagttcatggcccatttggcaacaacccttagatgccttactgccctagacacagaggggctagaaggctgactaattctcaatatgcattttatcactcagtccactcctgacattagaaaaagctccaaaaattaaattctggccctcaaaccccacaacaggacttaattaacctcaccttcaaggtctgcagtaatagagaagaggcagccaagtggcaacctatttctgagttgcaattacttgcctccgctgtgagagaaaccccagccacatctccagcacacaagaacttcaaaacacctaaaccgcagtggccaggcgttcctccaggacctcctcccccaggatcttgcttcaagtgccagaaatctggccaccaggccaaggaatgcccgcagcccgggattcctcctaagccgtgtcccatctgtgcaggaccccactagaaatcagactgtccaacttgcccagcagccactcctgtagcccctggaactctagcccaaggctctcggactgactccttcccagatctcctcagctcagtggctgaagagtgacactgcctgattgcctcagaagcctcctagaccatcacagatgctttgggtaacccttacagtggagggtaagtccgtccccttcttaatcaatatggaggctacacactccacattaccttcttttcaagggcctgtttcccttgcctccataactgttgtgggtattgatggccaggctgctagaccccttaaaactccccaactctggtgccaacttggacaacattcttttatgcactcctctttagttatccccacctgcccagttcccttattaggtcaagacattttaacaaaattatccgctaccctgactattcctggacttatagccacatctcattgctgcccttctccccaaccaaaagcctcctttgtgtcttcctcttgtatcccccccccaacttaacccacaagtatgggacacctctactccctccctggcaaccgatcacatgcccattactatcccaataaaacctaatcaactttactccactcagtgccagcatcccatcccacgacaggctttaaggggactaaagcctgttatcactcacctgctacagcatgggcttctaaagcctataaactctccttccaattcccccattatacctgtccaaaaaccagacaagtcttacaggttagttcaggatctgtgccttatcaaccaaattgtcttgcctatccaccccatggtgccaaacccatatactctcctattttcaatacctcccttcacaacccattattcggttctggatctcaaagatgctttctttactattcctttgcacccttcatcccgcctctctttgcttttacttggactgaccctgacaccaatcattctcagcaacttacctgggctgtatttccacaaggcttcagggacagccctcattacttcagccaagctctttctcatggtttactttctttccaccactctgcttctcaccttattcaatatattgatgaccttctactttgtagcccttcctttgaatcttctcaacaagacaccctcctgctccttcaacatttattctccaagggatatcgggtattcccctccaaagctcaaatttcttctccatccattacctacctcagcataattcttcatgaaaacacgcatgctctccctgccaattgtgtctggctgatctctcaaaccccaaccccttctacaaagcaacaactcctttccttgctgggcatggttggatacttttgcgtttggatacctggttttgccatcctaacaaaaccattatataaactcacaaatagaaaactagctgaccccatagatcctaaatcctttccccactcctctttccattccttgaaagcagcttgagaaactgctcccacactagctgtccctaactcatcccaaccctttttcattacatacagccaaagcatagggctgtgcggttggaattcttacacaagagctgggaccatgtcctgtagcctttctgtccaaacaacttgaccttactgttttaggctggaccccacattattcctgataccacacctgacccccatgactgtatctctctgatccacctggcattcactccatttccccatatttccttctttcctgtccctcaccctgatcacacttggtttattgatggcagttccaccatgcataattgccactcaccagcaaaggcaggctatgctatagtatcttccacatctatcattgaggccaccactctgccctattccactacctctcagcaagccgaactcattgccctaacttgagccctcactcttgcaaaaagactacgcatcaatatttatactgactttatatgccttccatatcctgcaccaccatgctgttatatgggctgaaagaggtttcctcactattcaagggtcctccatcattaatgcctctttaataaaaactcttctcaaggccgctttacttccaaaggaagctggagtccttcactgcaaaggccatcaaagggcctcagaccccattgctgataagacagctaaagatgcagccagtattcctatttctgtccctcatgaccagtttttctccttctcatcagtcactcctacttattctcccactgaagtttctacctatcaatcactccccactcagggcaaatggttcttggaccaaggaaaatatctccttccagcctcacaggcccattccattctgttgtcatttcataacctcttccatgtaagttacaagccactagcctgtctcttagaacctctcatttcctttccatcgtggaaatctgtcctcaaggaaatcacttctcagtgttccatctgctattctactactcctcagggatttctcagtccccctcccttccctacacatcaagctcggagatttgcccctgcccaggactggcaaattgactttactcacatgccccaagtcaggaaactaaaatacctcttggtctgggtagacactttcactggatgggtagaggcctttcccacagggtcttcgaaggccaccacagtcatttcttcccttcagtcagacataattccttggtttggccttcccacctctatacagtccgataatggaccggccttggtattcagtggaaacttcataccccttactgtcctcaatcttcaggaaaggtagaatggactaatggtcttttaaagacacacctcaccaagctcagcctccaacttaaaaaggactggacagtacttttacctcttgcccttctcagaattagagcctgtcctcaagatgtacagtccatttgaacttttatatggatgcactttcttgctcggccccaacttcatcccagacaccagccctctaggtgactatcttccagtcctccagcaggctagacagaaaattcgccaggctgctaatcttcttttgcctactccagattcccagccacatgaagacaccctagctggacgatcagttcttgttaagaatctgacccctcaaactctacaacctcgatggaccagaccctacttagtcatctatagtaccctacgtaccatctgcctgcaggaccctccccattaggttcactgatccagaataaagctgtgtccatcagacagccagcctgatctctcctcttcctcctggaagttgcaagtactcacccctacttcccttaaactcactcacattcctaaaggataatagtaacccttataatcctaacacatcctttcattcttattaggtctcttcttccttaccctactctttgcaacagggctttatgcagtcaccccccaacttggactgcaccccaaaaactagtcatccctactctcttctgtccagtcatactcctattcaccattttcaactactcataaatgccctgcccctgtttacactgctggtctacacttttcctccaaaccatcatagtggatatctcctggtactatccccaatctgccactcttgactccttcttggagtggatagatgatctttgctgacagggcaccctctgacactttcaccctgataaagtcctattatttacttttatactccctcttattcttgttcccgttcttatgccaccctctacctctccccagctatctccaccacactatcaatcttactcactctctcctagccatttctaatccttctttaacaaacaattgctggctttgcatttctctttcctccaaaaccactgaggccttgacgtactcactgctaaaaaaaggggactctgtatatttttaaatgaagagtgttgtttttacctaaatcaatctggcctggtatatgacaaaagaaaaaaaaaaaacactcaaggatagagctcaaaaactcgctactcagacaactgattaaactggacccacctggccactctctaactgggtatcctggcttcttccgatcgttagtctgatacctatcttcctctttctcttattcaggccttgtgtcttctgattaatctctcaattcatacaaaaccgcatccaggccaccaccaatcattctatacaaatgctctttctaataactccacaatattaccccttaccccaaaatctttcttcagtttaatctctcccactcaagtttcccacattgccccaatcctgctcgaagcagccctgagaaacatcacccattatctctccataccaccctcaaaaattttcgccgccccaacacttcaccactatttcattttgtttttcttattaatataaaaagacaggaatgtcaggcctctgagcccacgctaagccatcataacccctgtgacctgcacgtatacatccagatggcctggggcaactgaagaaccacaaaagatgacattccaccattgtgatttcttcctaccccagcccaactaatcagtcaaccttgtgacattcccccgctggacaatgagtctcatgatctccccaccctgcaccttgtgacccccacccctgcccgcaagagataaccacctttaactgtaattttccactacctaccccaatcctataaaactgccccaccccatctccctttgctgactcctttttcggcctcagcctgcctcagccaggtgaaataaacagcattattgctcatacaaagcctgtttggtggtctcttcacacggatgcacatga

SEQ ID NO: 552 - DNA, 563 bp, Homo sapiens
ttagagtaggcagttaggcagaactgagcagggcaggagagggcccctatcaggtcgtcaggcaaccatcaggtgatggtcaggcagttgttaaactgtgtcgctaaaatgataattggttgcagctggttccagggacctgcagtctcccagtagatagaaaatacctggagctagtgatcagcagcttcctgataagatctcaggagctaggcgagtcggttcaaacatgtgcactaagaggcaaaatgggagtttaactggtatatgaccttcctctgggaatgcttgactggtaagagaaaaatgcctcaaacgagcatacacacaacttcagtaaacgcactgcacatgcggcccctcccaagtgctggcaggtcactgtgcatgcagacagcctgccccaaggggaaaattaagggaagaaaaacacaaaccccggaaccatgccaatgtataaaaccccaagcccaaggctgaacagggcacttggatctcttatgttgcccacttgaccctcttccaagtgtactttgcttcctttcattcctgctctaaaactt

SEQ ID NO: 553 - DNA, 450 bp, Homo sapiens
gtcaggcctctgagcccaagccaagccatcgcatcccctgtgacttgcacttatacgcccagatggcctgaagtaactgaagaatcacaaaagaagtgaaaatgccctgccccgccttaactgatgacattccaccacaaaagaagtgtaaatggccagtccttgccttaagtgatgacattaccttgtgaaagtccttttcctggctcatcctggctcaaaaagctcccccactgagcaccttgtgacccccactcccatccgctagagaacaaacctcctttgactgtaattttcctttacctacccaaatcttataaaatggccccacccctatctcccttctctgactctcttttcggactcagcccacctgcacccaggtggttaaaagctttattgctcacacaaagcctatttggtggtctcttcacatggacgcgcatgaaa

SEQ ID NO: 554 - DNA, 6437 bp, Homo sapiens
gtcaggcctctgagcccaagctaagccatcatatcccctgtgacctgcacatacgcatccagatggccagttcctgccttaactgatgacattccaccacaaaaggagtgaaaatggcctgttcctgccttaactgatgacattatcttgtgaaattccttctcctagctcatcctggctcagaagctcccctactgagtaccttgtgacccccactccttcccgccagagaacaacccccttttgactataattttcctttacctacccaaatcttataaaaccgccccatccctatctcccttcactgactctctttttggactcagcccgcctgcccccaggtgattaaaaagctttattcctcacacaaagcctgtttggtggtctcttcacacgaacacgagtgaaatttggtgctatgacttggatcgggggacctcccttgggagagcaatcccctgtcctcctgctctttgttccatgagaaagatccacctacgacctctggtcctcagaccaaccagcccaaggaacatctcaccaactttaaatctggtaagcggcttctttttactctcttctccaacctctctcactatccctcaaccgctttctcctttcattcttggcaccacacttcaatctctcccttctcttaatttctgttcctttccttttctggtagagatgaaggagactcattttatccatggacccaaaactctggcaccagtcacagactcgaagacagtcttctcttggtgtttaatcatgtggggacgcctgcctgattatttacccacgtttcagaggtgtctgaccacatggggacgcctgccttggtcctgcacccttagtggcaagtaccacttttctggggggcaagaacccctccaaccccttctccttcacccttagtggcaagtaccacttttctggtgggcaagaaccccccaaccccttctccctcacccttagcagcaagtactgcttttctgggggacaagaaccccccaacccattctccttcaaccttggaggcaagtaccacttttctagggggcaagaaacccccgaccccttctctctgtgtctctactctctcttttctctgggcttgcctccttcactatgggcaggcttccgccctccattcctccttcttctcccttagcctgtgttcttcaaaacctaaaacctcttcaactcacatctgacctaaaacctaaatgccttatttacttctgcaatgccgcttgaacccaatacaaacttgacagtggttccaaacagccagaaaatggcactttcaattttttccatcctacaagatctaaataattcttgtcgtaaaatgggcaaacggtctgtggtgcctgacgtccaggcattctttcacttatcggtccctccctagtctctgttcccagtgcaacttgtcctaaatcttccttctttccctcctgcctgtcccctcagtcccaaccccgagcgtcactgagtctttctaatcttccttttctacagacccatctgacctctcccctcctcaccaggccgagctaggtcacaattcttcctcaacctccactcctccaccctataatccttttatcacctcccctcctcacacctggtccggcttacagtttcgttccgcgactagccctcccccacctgcccagcaatttcctcttaaaaaggtggctggagctaaaggcatagtcaaggttaatgctcctttttctttatcccaaatcggatagcatttaggctctttttcatcaaatataaaaccccggcccagttcatggctcatttggcagcaaccctgggatgctttacagccctagaccctaaaaggtcaaaaggccgtcttattctcaatatacattttattgcccaatccgctccggacattaaataaaactccaaaaattaaattccagccctcaaaccccacaacaggacttaattaacctcgccttcaaggtgtacaataatagagtagaggcagccaagcagcaacatatttctgagttgcgattcctcgcctccactgtgagacaaaccccagccacatctccagcacacaagaacttccaaacgcctaaaccgcagtggccaggtgttcctccaggcccgcctccccccaggagcttgccccaactgccagaaatctggccaccaggccaagggatgcctgcagccagggatttctcctaagccatgtcccatctgtgtgggaccccactgaaaatcggactgttcaactcacctggcagccactcctagaccccctggaactctggcccaaggctctccgactgactccttcccagttcttctcgacttagtggctgaagactgacactgcccgatcaccttggaagccccctagaccatcacggatgccgagctttgggtaactctcacagtggagggtaagtctgtccccttcttaatcaatatgaaatctacccactccacattaccttcttttcaagggcctgtttcccttgcctccataactgttgtgggtattgatggccaggcttctaaatctcttaaaactccccaactctggtgccaacttagacaatattttttaagcactcctttttagttatccccacctgcccagttcccttattaggcccagacactttaactaaattatctgcttccctgactattcctggactacagccgcatctcattgctgcccttcttcccaatccaaagcctcctttgcatcttcctcttgtatacctccaccttaacccacaggtatggggtacctctactccctccttgacgaccaatcatgcaccccttaccatctcattaaaacctaatcaaccttaccccgctcaatgccaatatcccatcccacagcatgctttaaaaggattaaagtctgttatcactcacctgctacagcatggccttttaaagcctacaaactccccttacaattcccccatttttcctgtcctgaaaccagacaagttttacaggttagttcaggatctgcgccttatcaaccaaattgttttgcctatccacactgtggtgccaaacccatatactctcctatcctcaatacctccctccacaacccattattctgttctggatctcagacatgctttctgtactattcctttgcacacttcatcccagcctctcttccctttcacttggactcaccctgacacccatcaggctcagcaaattacctgggctgtactgctgcaaggcttcacagacagcccccattacttcagtcaagcccaaatttcttcctcatctgttacctatctcagcataattctcacagaaacacctgtgctctccctgccgctcatgtccaactgatctctcaaaccccagcatcttctacaaaacaactcctttctttcctaggcaaggttagatactttcgactttagatacctggttttgccatcctaacaaaaacattatataaactcacaaaagggaacctaaatgaccccatagatcttaaatcctttccccactcctctttccattccttgaagacagctttagagactgcccacaccctagcttttcctgactcatcccaacccttttcattacccacagctgaagtgtagggctgtgcagtcagaattcttacacaagaaccgggactgcaccctgtagcctttttatccaaacaacttgaccttactgttttgcctagctctcaagtctgcgtgaggcagccaccaccaccgtaatacttttagaagcccttaagatcccaaactatgctcaactcactctctacagttctcataacttccaaaatctattttcttcctcatacctgacacatatactttctgctcctcggctccttcagctatactcactctttgctgagtctcccacaattaccattgttcctggcaagaacttcaatccggcctcccacattattctggataccacacccgaccttcatgactgtatctctttgatccatctgacattcaccccatttccccatatttccttctttcctgttcctcaccctgatcacatttggtttattgatggcagttccacaaggtctaatcgccactcaccagcaaaggcaggctatgctatagtatcatccacatctatcattgaggctaccgctgtggccccctccactacctctcagaaagccgaactagttgccttaactcaagccctcactcttgcaaaagaactatgcatcaatatttatactgactctaaatatgcctttcatattctgcaccaccatgttgttatatgggctgaaagaggtttcctcactatgcaaaggtcctccatcattaatgcctctttaataaaaactctgctcaaggctgctttacttccaaaggaagctggagtcattcactgcaaaggccatcaaaaggcgtgagatcccattgctctaggcaacgcttatgctgataaggtggctagacaagcagctagctttccaacttctgtccctcacggctagtttttctccttcacatcggtcgctcccacctactcctccgctgaaacttccacctatcaatctcttcccacacaaggcaaatggttcttagaccaaggaaaatatctccttccagcctcacaggcccattctattctgtcataatttcataacctcttccttgtaggttacaagccactaggcagtctcttagaacctctcatttcctttccatcctggaaatctatcctcaaggaaattacttctcagtgttccatctgctattctactaccccgcagggattgctcaggcctcctcccctccctacacatcaagctcagggatttgcccccgcccaggactggcaaattgactttactcacatgcccccagtcagaaaactaaaatacctcttagtctgggtagacactttcactggatggatagaggcctttcctacagggtctgagaaggccaccacggtcatttctttccttctgtcagacataattccttggtttggccttcccacctctatacagtttgatagcagaccggcctttattagtcaaatcagccaagcattttttcaggctcttggtattcagtgaaacctttatatcccttatggtcctcagtcttcaggaaaggtagaacagactaatggtcttttaaaaacacacctcaccaagctcagccaccaacttaaaaaggactggacaatacttttaccactttcccttctcagaattcaggcctgtcctcggaatgctacagggtacagcccatttgagctcctgtatggacgctgttttttattaggccccagtctcattccagacaccagaccaacttggactgtgccccaaaaaacttgtcatccctactatcttctgtctggtcatactcctaattcacctttctcaactactcatacatgccctgctcttgtttacactgctggttttcactgtttctccaagccatcacagctgatatctcctggtgctatccccaaactgccactcttaactcttaaagtaaataaataatctttgctggcaggactatgctgaatctccttaggcactctctaattagatgtcctgggtcctcccaattcttagacttttaatacctgtttttctctttctcttattccatttagtttttcaattcatacaaaactgtaaccaggccatcaccaataattctaaatgacaaatgtttcttctaacaaccccacaatatcacccacaatatcaccccttaccacaaaatcttccttcagcttaatctctcccactctagcttcccacgctgcccctaatcccacttgaagcagccctgagaaacatcgcccattgtctctccataccacccccaaaaattttcaccatcccaacactttaccactattttgttttatttttcttatttatataagaagacaggaatgtcaggcctctgagcccaagctaagccatcatatcccctgtgacctgcatgtacacatccagatggccagttcctgccttaactgatgacattccaccacaaaagaagtgaaaatggccagttcctgccttaactgatgacattccaccacaaaagaagtgaaaatggcctgttcctgccttaactgatgacgttatcttgtgaaattccttctcctggctcatcctggctcaaaagctcccctactgagcaccttgtgtcccccactccttcccaccagagaacaacccccctttgactgtaattttcctttacccacccaaatcttataaaacggccccaccccatctcccttccctgactctcctttcggactcagcctgcctgcaccaaggtgattaaaaagctttattactcacacaaagcctgtttggtggtctcttcacacggacgcgagtgaaa

SEQ ID NO: 555 - DNA, 312 bp, Homo sapiens
tgggtcaggcacaaagtaagcccaccccactaggaactatgttgaaaaatttcaagaaaggatttaagggagattacagtggtactatgacaccaggaaaacttagaactttgtgtgacatagactggccagcattagaggtgggttggccatcagaaggaagcctggacaggtcccttgttacaaaggtatggcacaaggtaacctgtaagccagggcccccagaccagttcccgtacatagacacttggttacaactggttttagaccctcccgccccacacagtggttgagagaacagcagcataagtg

SEQ ID NO: 556 - DNA, 54 bp, Homo sapiens
tgccccactggaatgtcaggtccatgaggacagtgatgcaagtggctaataaac

SEQ ID NO: 557 - DNA, 345 bp, Homo sapiens
tgggtcaggcacaaagtaagcccaccccactaggaactatgttgaaaaatttcaagaaaggatttaagggagattacggtgttactatgacaccaggaaaacttaggactttgtgtgaaatagactggccagcattagaggtgggttggccatcagaaggaagcatggactggtcccttgtttcaaaggtatggcacaaggtaacctgtaagccagggtgcccagaccagttcccgtacatagacacttggttacagctggttttagaccccctccctacccccacggtggttgagagaacagcagcataagcagctggcagaggcaaggaaagaccagcaaaga

SEQ ID NO: 558 - DNA, 5496 bp, Homo sapiens
gtcaggcctctgagcccaagccaagccatcgcatcccctgtgacttgcatgtatacgcccagatggcctgaagtaactgaagaatcataaaagaagtgaatatgccctgccccaccttagctgatgacattccaccacaaaagaagtgtaaatggccggtccttgccttaagtgatgacattaccttgtgaaagtccttttcctggctcatcctggctcgaaaagcacccccactgagcaccttgcgacccccactcctgcccgccagaggacaaaccccctttgactgtaattttcatttacctacccaaatcctataaaatggccccacccttatctcccttcgcggactctcttttcggactcagcccgcctgcacccaggtgaaataaacagccatgttgctcacacaaagcctgtttggtggtctcttcacacagacgcgcatgaaatttggtgccgtgactcagatcgggggacctcccttgggagatcaatcccctgtactcctgttctttgctccgtaagaaagatccacctacaacctcaggtcctcagaccgaccagcccaaggaacatctcaccaattttaaatcaggtaagtggcctcttcttactctcttctccaacctctctcactgtccctcaaccactttctcctttccactcttcaatctctcccttctcttagtttcaattcctttcattttctgggagagacaaaggagacatgttttatccgtggacccaaaactccagcgccggtcacggactgggaaggcagccttcccttggtgtttaatcattgcagggacacctctctgattatacacccacgtttcaagggtgtcagactgcgcagggatgcttgccttggtccttcacccttagtagcaagtcccgcttttctggggaaggggcaagtacctcaaccccttctctccttgtctctaccccttctctgcttttctgggagaggggaaagtacccctcaaccccttctccttcacccttagcagcaagtcccacttttctacggggcaagaacccccaatcccttatgtccatgccccaacctcttatctctgtgccccaatcccttatttctgcaccccaacctcttatctctgtgccccaatcccttatttccgcaccccaacctcttatctctgtgccccaatcccttttgtccatgccccaacctcttatctctgcgccccatcccttatttccacaccccaacctcttatctctgtgccccaatcccttatttccgcaccccaacctcttatctctgtgccccaaccccttttcccacttttctggaaggtaagaacccctgaaccccttccctccgtttctctactctctcttttctctaggcttgcttccttcactatgggcaactttccaccctccattcctccttctactcccttggcctgtgttctcaaaaaacttaaaacctcttcaactcacacctgacctaaaacctaaatgccttattttcttctgcaatgctgctcgaccacagtacaaactcaacagtagttccacatagccagaaaatggaactttgaatttttccatcctgcaaaatctaaataattcttgtcgtaaaataggcaaccggtctgaggtgcctgatgtccaggcattcttttacacatcggtcccttccttgtctctgtgcccagtgcaactcgtcccaaatcttccttctttccctcccgcctgtcccctcagtcccaagcccaagcgtcactgagtctttctaatattccttttctacagacccatctgacctctcccctcctcgccaggccaagctaggtcccaattcttcctcagcctccgctcctccaccctgttatctttttatcacctcctctcctcacacctggtctggcttacagtttcattctgtgactagccctcacccacctgcccaggaatttactcttaaaaaggtggctggagctaaaggcatagtcaaggttaatgctcctttttctttatcccaaatcagatagcgtttaggctctttttcatcaaatataaaaacccagcccagttcatggctcgttccgtagcaaccctgagacgttttacagccctagaccctaaaaggtcaaaaggccgtcttattctcaatatacattttattacccaatctgctcccgacattaaataaaactccaaaaattaaattccggccctcaaaccccacaacaggatttaattaacctcgccttcaaggtgtacaataatagaaacaagttgcaattccttgcctccactgtgagacaaaccccagccacatctccagcacacaagaacttccaaacgcctgaaccacagcagccaggcgttcctccagaacctcctcccccaggagcttgctacacatgctggaaatctggccactgggccaaggaatgcctgcagcccgggattcctcctaagccacgtcccatctgtgtgggaccccactgaaaatcggactgttcaactcacctggcagccactcccagagcccctggaactctggcccaaggctctctgactgactccttctcggcttagtggctgaagactgacgctgcccgatcacctcagaagccccgtagaccatcacggacgtgacgctgagttttgggtaactctcacagtggaaggtaagtccatcccgttcttaatcaatacggaggctacccactccacattaccttcttttcaagggcctgtttcccttgcctccataactgttgtgggtattgatggccaggcttctaaacctcttaaaactccccaacttagacaatactcttttaagcactcctttttagttatccccacctgcccagttcccttattaggctgagacactttaactaaattatctgcttccctgactattcctggactacagcgatatctcattgcctcccttcttcccaatccaaagcctcctttgtgtccccctcttgtattcccccaccttaacccacaagtataagatacctctactccctgcttggcgaccgatcatgcaccccttgccatctcattaaaacctaatcacccttaccccactcaacgccaatatcccatcccgcagcatgctttaaaaagattaaagcctgttatcactcgcctgctacagcgtggccttttaaagcctataaactctccttacaattcccccattttacctgtcctaaaaccagacaagccttacaagttagttcaggatctgtgccttatcaaccaaattgttttgcctatccaccccgtggtgccaaacccatatactctcctatcctcaatacctgcctctataacccattattctgttctagatctcaaacatgctttctttactattcctttgcacccttaataccagcctctcttcactttcacttggactgaccctgtaacccatcaagctcagcaaattacctaggctgtactgctgcaaagcttcacagacagcccccattacttcaataaagcccaaatttcttcctcatctgttacctatctcggcataattctcataaaaacacacgtgctctccctgccaatcgtgtccgactgatctctcaaaccccagcaccttctacaaaacaacaactcctttccttcctaggcatggttagtatggtcagaattcttacacaagagccaggaccacaccctgtagcctttctgtccaaacaacttgaccttactgttttagcctagccctcatgtctgcgtgcagcggctgccgctgcattaatacttttagaggccctcaaaatcacaaactatgctcaactcactccctacatttctcataactttcaaaatctattttcttcctcatacctgatgcatatactttctgcttcccggctccttcagctatactcactctttgttgagtctcccacaattaccgttgttcctggcccagacttcaatctggcctcccacattattcctggtaccacacctgatccccatgactgtatctctcggatccacctgacattcaccccatttccccaaatttccttctttcctgttcctcaccctgatcacgcttgatttattgatggcagttccaccagacctaatcgccacacaccagcaaaggcaggttatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagctcgaggatttgccccacccaggactggcaaattagctttactcaacatgccctgagtcagataactaaaatacctcttagtctaggtagatactttcactggataggtagaggcctttcctacagggtctgagaaggccaccacagtcatttcttcccttctgtcagacataattcctcagtttagccttcccacctcaatacagtctgataacagacgagcctttattagtcaaatcagccagcagtttttcaggctcttagtattcagtgaaacctttatatcccttacggtcctccgtcttcaagaaaagtagaatagactaaaggtcttttaaaaacacacctcaccaagctcagccaccaacctaaaaaggactggacaatacttttaccactttcccttctcagaagtcagacctgtcctcagaatgctacaaggtacagcccatttaagctcctatatagacgctcctttttattgggccccagtctcattccagacaccagaccaagttagactgtgcccccaaaaaacttgtcatccctactatcttctgtctagtcatactcctattcaccgttctcaactactcatacatgccctgctcttgtttacactgccggtttacattgtttttccaagccatcacagctgatatctcctggtgctatccccaaactgccactcttaactcttgaagtaaataaataatctttcctggcaggactatgccgaatctccttaagcactctctaatcagatatcctgagtcgtcccaattcttagaccttttatacctgtttttctccttccattattacatttagtttctcaattcatccaaaaccatatccaggccatcaccaatcattctatacgacaaatgtttcttctaacatccccacagaatcaccccttaccacaagacctcccttcagcttaatctctcccactctaggtttccacgccgccccaatcccgcttgaagcagccctgagaaacatcgcccattctctctccataccaccccccaaaaattttcgccgccccaacacttcaacactattttgttttatttttcttattaatataagaaggcaggaatgtcaggcctctgagcccaagccaagccatcgcatcccctgtgacttgcacgtataggcccagatggcctgaagtaac

SEQ ID NO: 559 - DNA, 968 bp, Homo sapiens
gtggggaaaagcaagagagatcagactgttactgtgtctatgcagaaagaagtagacataagagactccattttgttctgtactaagaaaaattcttctgccttgagatgctgttaatctgtaaccctacccccaaccctgtgcagaaacatgtgctgtgtggactcaaggtttaatggatttaaggttatgcaggatgcgctttgctaaacaaatgcttggagtcagcatgcttgttaaaagtcacaaccactccctaatctcaagtacccagggacacaaaacactgtggaaggctgcagggacctctgcctaggaaagccaggtattgtccaaggtttctccccatgtgatagtctgaaatatggcctcgtgggaagggaaagacctgaccatcccccagcccgacacccctaaagggtctgtgctgaggaggattagtaaaagaggaagtcctctttgcagttgagataagaggaaggcatctgtctcctgctgctcgtccctgggcaagggaatgtctcagtgtaaaaccggattgtatattccatctactgagataggagaaaaccgccttagggctggaggtgagacatgctggcagcaatactgctctttaatgcactgagatgtttatatatgtgcacatcaaagcacaacacctttttcttaaccttgtttatgacgcagagacatttgttcacatgttttagctgctgaccctctccccactactaccctattgtcctgccacatccacttctctgagatggtagagataatgatcaataaatactgagggaactcagagactggtgctggcgcaggtcctctgtatgctgagcgcctgtcccctgggctcatttttctttctctatactttttctctgtgtctctttcttatgtcagtctcttgtcccacccgacgagaaacacccacaggtgtggaggggcaggccaccccttca

SEQ ID NO: 560 - DNA, 5698 bp, Homo sapiens
gttaggcctctgagcccaagccaagccatcgcatcccctgtgacttgcacatatatgcccagatggcctgaagtaactgaagaatcacaaaagaagtgaaaaggccctgccccgccttaactgatgacattccaccactgtgatttgttcctgccccaccttaactgagtgattaaccctgtgaatttccttctcctggctcagaagctaccccactgagcaccttgtgacccccgcccctgcccaccagagaacaacctcctttgactgtaattttccattaccttcccaaatcctataaaacggccccacccctatctcccttcgctgactctcttttcggactcaaccgcctgcacccaggtgaaataaacagccatgctgctcacacaaagcctgtttggtagtctcttcacacggacacacatgaaatttggtgccatgactcggatcgggggacctcccttgggagatcaatcccctgtcctcctgctctttgctccatgagaaagatccacctacgacctcaggtcctcagactgaccagcccaagaaacatctcaccaatttcaaatccggtaagcggcctctttttactatcttctccagcttccctcactatccctcaacctctttctcctttcaatcttggcaccacacttcaatctctcccttctcttaatttcaattcctttcattttctggtagagacaaaggagacacgttttatccatggacccaaaactccggtgccggtcacggactgggacggcagccttcccttgatgtttaatcattgcagggacacctctctgattattcacccacgtttcaaaggtgtcagaccacgcagggacacctgccttggtccttcacccttagcggcaagtcccgcttttctggggaaggggcaagtaccccaaccccttctctccttgtctctaccccttctctgcttttctgggggaggggcaagaacccctcaaccccttctccttcacccttagtggcaagtcccacttttctgggggaggggcaagtacccctcaaccccttctccttcacccttagcagcaagtcccacttttctagggggcaagaacccccaatcccttatttccgctccccaacctcttatctctgtgccccaattccttatttccatgccccaaccctttctctgcttttctggagggcaaggaacccctaccccttctctgtgtctctactcttttctctgggcttgcctccttcactatgggcaagattccaccttacattcctcctccttctcccttagcctatattcttaagaacttaaaacctctccaactttcactgacctaaaatctaagcgtcttattttcttctgcaatgccgcttgaccccaatacaaacttgacagtagttccaaacaccggaaaatggcactttcaatttttccatcctacaagatctaaataattcttgtcgtaaaaggggcaaatggtctgaggtgcctgacgtccaggcattcttttacacatcagtcccttcctagtctctgtgcccagtgcaactcatcccaaatcttccttctttccctcccgcctgtcccctcagtcccaaccccaagcgtcgctgagtctttctaatcttccttttctatagacccatgtgacctctcccctcctcaccaggccaagctaggtcccaattcttcctcagcctctgctcctccaccctgtaatctttttatcgcctcccctcctcacacctggtccggcttacagtttccttctgtgactagccctccccaacctgcccagcaatttactcttaaaaaggtgactggagccaaaggcatagtcaaggttaatgctcatttttctttatcccaaatcagaagcgtttaggctctttttcatcaaatataaaaacccagcccagttcatggcttgtgtggcagcaaccctgagatgctttacagccctagaccctaaaaggtcaaaaggccatcttattctcaatatacattttattacccaatctgctcccgacattaaataaaactccaaaaattagaatctggccctcaaaccccacaacaggacttaaccttaccttcaaggtgtacaataataaaaaaaaagttgcaactccttgcctccactgtgagacaaaccccagccacatctccagcacacaagaacttccaaacgcctgaaccgcagcagccaggcgttcctccagaacctcctcccccaggagcttgctacaagtgccagaaatctggccaccaggccaaggaatgcctgcagcccaggattcctcctaagccgtgtcccatctgtgcgggaccccatgggaaatcggactgttcaactcacctggcagccactcccagagcccctggaactctggcccaaggctctctgactgactccttcttggcttagcggctgaagactgatgctgtctgattgcctcggaagccccatagaccatcacggatgctgagctttaggtaactctcagagtggagggtaagtccgtccccttcttaatcaatacgaaggctacccactccacattaccttcttttcaagggcctgtttcccttgcctccataactgttgtgggtattgacagccaggcttctaaacctcttaaaactccccaactctggtgccaacttagacaatactcttttaagcactcttttttagttatccccacctgcccagttcccttattaggccgagatattttaaccaaattatctgcttccctgactattcccggactatagccgcatctcattgctgccgttcttcccaatccaaagcctcctttgcgtcctccttttgtattcccccaccttaacccacaagtataagatacctctactccctccttggcgaccgatcacgcaccccttaccatctcattaaaacctaatcaccctcaccccactcaatgccaatatcccatcccacagcatgctttaaaaggattaaagcctgttatcactcgcctgctacagcatgggcttctaaaacctataaactctccttaccattcccccattttacctgtcctaaaaccagacaaggcttaaaagttagttcagaatctgcgccttatcaaccaaattgttttgcctatccaccccgtggtgccaaacccatatactctcctatcctcaaaacctccgtctacaatccattattctgttctggatctcaaacatgctttctttactattcctttgcacccttcatcccagcctctctttgccttcacttagactgaccctgacacacattaggctcagcaaattacctgggctgtactgccgcaaggcttcacagacagcccccgttacttcagtcaagcccaaatttcatcctcatctgttacctatcttggcataattctcataaaaacacaggtgctctccctgctgatcatgtccaattaatctccaaaacctcaatcccttacaaaacaacaactcctttccttcctaggcatggttagtgtggtcagaattcttacacaagagccaggaccacaccgtgtagcctttctgtccaaacaaattgaccttactgtcttagcctagccctcatgtctgcatgcagcggctgccgctgctttaatactgttagaggccctaaaaaatcacaaactatgctcaactcactctctacatttctcgtaacttccaaaatctattttcttcctcatacctgacgcatatactttctgctccccagctccttcagctgaactcactctttaagtcccacaactaccattgtttctggcccggacttcaatctggcctcccacattattcctgataccacacctgacccccatgactgtatctctctgatccacctgatattcaccccatttccccatatttccttctttcctgtccctcaccctgaacacacttggtttattgatggcagttccaccaggcctaatcgccacacaccagcaaaggcaggctatgctatagtacgagccactagcccgcctctcagaacctctcatttcctttccatcgtggaaatctatcctcaaggaaataacttctcagtgttccatctgctattctactactcctcagggattattcaggccccctcccttccctacacatcaagctccaggatttgcccccacccaggacgggcaaattagctttactcaacatgtcccgagtcaggaaactaaaatagctcttagtctaaatagacgctttcactgaataagtaatggcctttcctacagggtctgagaaggccaccacagtcatttcttcccttctgtcagacataattcctcagtttagccttcccacctctatacagtctgataacagaccagcctttattagtcaaatcagccaagcagtttttcaggctctcagtattcagtgaaacctttatatcccttatggtcctccgtcttcaagaaaagtagaacggactaaaggtcttttaaaaacacacctcaccaagctcagccaccaacttaaaaaggactggacaatacttttaccactttcgcttctcagaattcaggcctgtcctcagaatgctacaaggtacagcccatttaagctcctgtatagacgctcctttttattaggccccagtctcattggacaccagaccaacttagactgtgccccaaaaaaacttgtcatccctactatcttttgtctagtcatactcctattcaccattctcaactactcatacatgccctgctcttgtttacactgctggtttacactgtttctccaagccatcacagctggtatctcctggtgctatccccaaactgccactctaaactcttgaagtaaataaataatctttgctggcaggactatggtgaatctccttaggcactctctaatcagatgtcctagctctcccaattcttagactttttatacctgtttttctccttctcttattccatttagtttttcaattcatacaaaaccgtatccaggccatcaccaatcattctatatgacaaatgtttcttctaacaaccccacaatatcaccccttaccacaagacctcccttcagcttaatctctcccactctaggttcccacactgcccctaatcctgttgaagcagccctgagaaacatcgcccattctctctccataccacccccaaaaattttcgccgccccaacacttcaacactattttgttttatttttcttattaatataaggaagcaggaatgtcaggcctctgagcccaagccaagccgtcgcatcccctgtgagttgcaggtatacgcccagatggcctaagtaactgaagaatcacaaaagtgaaaaggccctgccccgccttaactgatgacattccaccattgtgatttgttcctgccccaccttaactaagtgattaaccgtgtgaatttccttctcctggctcagaagctcccccactgagcaccttgtgaccccgcccctgcccaccagagaacaaccccctttgactgtaattttccattaccttcccaaatcctataaaacggtcccacccctatctcccttcgctgactctctttttggactcagcccacctgcacccaggtgaaataaacagccatattgctcacacaaagcctgtttggtggtctcttcacacggacccgcatgaaa

SEQ ID NO: 561 - DNA, 5673 bp, Homo sapiens
gtcaggcctctgagcccaagctaagccatcatatcccctgtgacctgcacgtacacatccagatcgacagttcctgccttaactgataacattccaccacaaaagaagtgaaaatggcctgttcctgccttaactgatgacattgtcttgtgaaattccttctcctggctcatcctggctcaaaagctcccccactgagtaccttgtgacccccactcctgcctgccagagaacaacccccccttttgctttacctacccaaatcctataaaacagctccacccctatctcccttcactgactctctttttggactcagcccacctgcacccaggtgaaataaacagctttattgctcacacaaagcctgttggtggtctcttcacacggacgcacatgaaatttggtgccgcgactcagatcaggggacctcccttgggagatcaatcccctgtcctcctgttctttgctccgtgagaaagatccacttacgacctcaggtcctcagaccgaccagcccaaggaacatctcaccaattttaaatcgggtaagcagactcttcttactctcttctccaacctctctcactgtccctcaaccactttctcctttccactcttcaatctcttccttctcttaatttcaattcctttcattttctggtagagacaaaggagacacgttttatccgtggacccaaaactctggcgccagtcatggactagggaaggcagccttcccttggtgtttaatcattggagggacacctctctgattattcgtccaggtttcagaggtgtcagaccacgcagggacgcctgccttggtccttcatccttagtggcaagtcccgcttttctggggaaggggcaagtaccccaaccccttctctctgtgtctctacctcttttccacctttctggggggcaagaaacccccaaccccttttccttcaccctgagcagcaagtcccgcttttctagaggaggggcaagtaccccaacctcatatctctgtgcccccatcccttatttccgtgccccaacctcttatatcgctgtaccccaatccattatttctgtgccctaacctcttatatctctgcaccccaatcccttatttccatgccctgaccttgtatctctgtgccccgacccctttcccgcttttctggagggtaagaacccccaaaccccttccctccatgtctctactctctcttttctctgggtttgtctccttcactatgggcaaccttccaccctccattcctccttcttctcccttagtctgtgttcttaagaacttaaaacctcttcaactctcatctaacctaaaatctaagtgtcttattttcttctgcaatgccgcttgaccccaatacaaactcgacagtagttccaaatagccagaaaacggcactttcaatttttccatccttcaagatctaaataattcttgttgtaaaatgggcaaatggtctgaggtgcctgacatccaggcattcttttacacatcagtccctctatagtctctgttcccaatgcaactcatcccaaatcttcctcctttccctcccacctgtcccctcagtcccaaccccaagcatcactgagtctttctactcttccttttctacagacacatctgacctctcccctcctcgccaggccgagctaggtcccaattcttcctcagcctccggtcctccaccctataatccttttatcatctcccctcctcacacccggtccggcttacagtttcattccgtgactagccctcacctgcccagcaatttactcttaaaaaggtggctgaagctaaaggcatagtcaaggttaatgctcctttttctttatcagacctctcccaaatcagtgagcatttagactctttcatcaaatatgaaaaacccagcccagttcatgactcgtttggcagcaaccctgagacactttacagccctagaccctaaaaggtcaaaaggccgtcttattctcaaaatacattttattacccaatctgctcccgacattaaataaaactccaaaaattaaattctggccctcaaaccccacaacaggatttaatcaacctcgccttcaaggtgtacaataatagaaaaaagttgcaattccttgcctccactgtgagacaaaccccagccacatctccagcacacaagaacttccaaatgcctgaaccacagcgggcaggcgttcctccagaacctcctcccccaggagcttgctacaagtgccagaaatctggccaccaggccaaggaatgcctgcagcccaggattcctcctaagccacgtcccatctgtacggaaccccactggaaatcggactgtccaactcacccggcagccactcccagagcccctggaactctggcccaaggctctcagactccttcccagatcttcttggcttagcggctgaagactgacgctgcccaatcgcctcggaagccccctagaccatcatggatgccgagcttcgggtaactctaacagtgaaggataagtctgtccccatcttaatcaataccaaggctactcactccacattaccttcttttcaagggcctgtttcccttgcctccataactgttgtgggtattgatggccaggcttctaaacctcttaaaagtccccaactctggtgccaaattagacaatactcttttaagcactccttttaattatccccacctgcccagttccctattaggccgagacactttaactaaattatctgcttccctgactattcctggattacagctacatctcattgctgcccttcttcccaatccaaagcctcctttgcgtgctcctcttgtattcccccaccttaacccacaagtataagatacctctactccctccttggcaaccgatcatgcaccccttaccatctcattaaaacctaatcacccttactccaatcaatgccaatatcccatcccacagcatgctttgaaaggattaaagcctgttatcacttgcctgctacagcatggccatttaaagcctataaactctccttacaattcccccattttacctgtcctaaaaccagacaagccttacaagttagttcaggatctgcgccttatcaaccaaattgttttgcctatccaccccgtggttccaaatccatatactctcctatcctcaatacctccctccacaatccattattctgttctggatctcaaacatgctttctttactattcctttccacccttcatcccagcctctcttggctttcacttggactgaccctgacacccactaggctcagcaaattacctaggctgtactgccgcaaggcttcacagacagcccccattacttcagtcaagcccaaatttcatcctcatctgttacctatctcggcataatctcataaaaacacacgtgcgttccctgctgatcgtgtccgattaatctcccaaacctcaatcccttacaaaacaacaactcctttccttcctaggcatggttagtgcggtcagaattcttacacaagagccaggaccgcaccctgtagcctttctgtccaaacaacttgaccttactgttttagcctaggcatcatgtctccgtgcagcggctgctgccaccctaatacttttagaggccgtcaaaatcacaaactatgctcaacttactctctacatttctcataacttccaaaatctattttcttcctcatatctgacgcatatactttctgctccccggctccttcagctgtactcactctttgttaagtcccacaattaccattgttcctggcccggacttcaatccagcctcccacattattcctgataccacacccgacctccatgactgtatctgtctgatcctcctgacattcaccccatttccccatatttccttctttcctgttcctcaccctgatcacgcttgatttattgatggcagttccactaggcctaatcgccacacaccagcaaaggcaggctatgctatagtacaagccactatcccgcctctttgaacctctcatttcctttccatcgtggaaatctatcctcaaggaaataacttctcagtgttccatctactattctaccactcctcagggattattcaggccccctcccttccctacacatcaagcttgaggatttggccccacccaggactggcaaattagctttactcaacatgcccggagtcagataactaaaatacctgttagtctaggtagacactttcactggataggtagagtcctttcctacagggtctgagaaggccaccacagtcattttttcccttctgtcagacataattcctcagtttagccttcctacctcaatacagtctgataacagacaagcttttattagtcaaatcagccaagcagtttttcaggctcctagtattcagtgaaacctttatatcccttacggtcctccatcttcaggaaaagtagaacagactaaaggtcttttaaaaacacacctcaccaagctcagccaccaacttaaaaaggactggataatacttttatgactttcccttctcagaagtcagacctgtcctcagaatactacaaggtacagcccatttgagctcctgtatagacgttcctttttattaggccccagtctcattccagacaccagaacttagactgtgccccccaaaaacttgtcatccctactatcttctgtctagtcatactcctattcaccgttctcaactactcatacatgccctgctattgtttacactgccggtttacagtttctccaagccatcacagctgatatctcctggtgccatccccaaactgccactcttaactcttgaagtaaataaataatctttgctggcaggactatgctgatctccttaggcactctctaagcagatgtcctgagtcatcccaattcttagaccttttatacctgtttttctccttctcttattccgtttagtttttcaattcatacaaaactgttatccaggccatcaccaatacttctaaattacaactattccttctaacaaccccacaatatcaccccttaccacaaaatcttccttcagcttaatctctcccactctaggttcccacgcccccccaatcccactcaaagcagccctgagaaacatcgcccattatctctccataccatcccccaaaatttttgctgtcccaagactttaccactatttcattttatttttcttattaatataagaagacaggaatgtcaggcctctgagcccaagctaagccatcatatcccgtgacctgcacgtacacatccagatcgcgggttcctgccttaactgataacattccaccataaaagaagtgaaaatggcctgttcctgccttaactgatgacattgttttgtgaaattccttctcctggctcatcctggctcaaaagcgcccccactgagtacctgtgccccccactcctgcctgccagagaacaacccccctttttcctttacctacccaaatcctataaaacggccccacccctatctcccttcactgactctctttttggactcagcccacctgcacccaggtgaaataaacagctttattgctcacacaaagcctgtttggtggtctcttcacacggacgcgcatgaaa

SEQ ID NO: 562 - DNA, 687 bp, Homo sapiens
ttactgtaggtagtcaggctgacatgagcagggcagaagaccagcctcctccccaccccccaccaggaatgtcaggcgaccatcaggtgatggtcagacaattcttaagctgtctctctaaaagaataattggttgcagccagcaccagggaacagcattctcccaatagatggagaaaacctgaaactgaagatcagcaacttcctcataggatctcaggaactgggtgagtgggctcaagcatgcgcactaagaggcaaaatgctggcattattaaaaaacgcctcaagggagcatgcgtacaactccagcaaacacactgcacatgaggcccctcccaagtgctggcaagccactgcgcatgcggacagcccaccccaagggaagaaccaggggagaagcaacactagaccccagaagtatgccaacatgtaaaaccctaagtcaaagctcaaaccgtgcccttgatctttcatgtcgccaacctggccctcttctaagtgtactttactttcgttcctgctctagaactttttaataaactttcactcctgctctaaaacttgccttggtctctcactctgccttatgcccctcagtggaattctttcttctgaggaggcaagaattgatcgaggttggtgcagacccatacagattcgccaccactcacatactttggtgcc

SEQ ID NO: 563 - DNA, 703 bp, Homo sapiens
tacagcaggtagtcaggcagacataagcaggggcaggagagggacccccaccatcaggaatgtcagtcaaccatcaggtgatggtcaggcagttagtaaactaaatttctaaaataataattggtcacagccagcgccaggaaaaggcagtctcccagtagacagaaacatctgaaactggtgatcagcagcttctcgataagatctcaggagttgggtgagtgggctcaagcacgttcactaaaaggcaaaatggcagtttaactggtatatgaccttctatggacatttggctggtaagagaacacttcaagtaagcgtgtttacagcgtcagtaaacacatgtgctcacctcccacacactagcaggccactgcacatgtggacagctcaccccaagagaagaatcaggggagaagggacgcaagaacctggaagtttgccgacgtataaaaccccaagtcaaaggtcaaacagcacacttgtctttcaagttgcccacttggccctcttccaagtatactttcctttgtgttattcctgctctgaagctttttaataagctttcagtcctgctctaaaacttgcctctgtctccccttctgccttaggcccctcagtctaattctttcttctgagaaggcaagaactgaggtagctgcagacctatacagatttgctgttcataacatactgtggtgcc

SEQ ID NO: 564 - DNA, 784 bp, Homo sapiens
aaccaagcaaataatcacgctgaacccccttgggcactgtctaattggatgtcctaggtcctcccaattcttagtccttaaatacctgtttttctcctcttatttggaccttgtgtcttccgtttagtttctcaattcatacaaaactgcatccaggccatcaccaatcattctatacgacaaatgctccttctaacaaccccacaatatcaccccttaccgcaaaatcttccttcagcttaatctctaggttcccatgctgcccctaatcccactcaaagcagccctgagaaacatcgcccattatctctccataccacccccaaaaattttcgccgccccaacacttcatcactattttgttttacttttcctattaatataagaagacaggaatgtcaaggtctctgagcccaagctaagccatgatatcccctgtgacctgcacttatacatccagatggcctgaagcaactgaagaatcacaaaagaagtgaaaatggcccggttcctgccttaactgatgacactgtcttgtgaaattccttctcctggacaatgagtctcagaagttccccacggaggagcacattgtgagcccccgccctgcccaccagagaacaacccctttaactgtaattttccactacctacccaaattccataaaactgccccacccctatctccgtctgctgactctcttttcggactcagccggcctgcacccaggtgattaaaaagttttattgctcacacaaagcctgtttggtggtctcttcacac

SEQ ID NO: 565 - DNA, 967 bp, Homo sapiens
gtggggaaaagcaagagagatcagattgttactgtgtctgtgtagaaagaagtagacataggagactccattttgttatgtactaagaaaaattcttctgccttgagattctgttaatctataaccttacccccaaccccgtgctctctgaaacatgtgctgtgtcaactcagagttaaatggattaagggcggtgcaagatgtgctttgttaaacagatgcttgaaggcagcacgctcattaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccttaaagggtctgtgctgaggaggattagtaaaagaggaaggaatgcctcttgcagttgagacaagaggaaggcatctgtctcctgcccgtccctgggcaatggaatgtctcggtataaaacccgattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctcttcgagaaacacccacaaatgatgaataaatactaggggaactcagaggctggcgggatcctccatatgctgaacgctggttcctctgttccccttatttctttctctatactttgtctctgtgtctttttcttttccaaatctctcgtcccaccttaggagaaacacccacaggtgtgtaggggcaacccacccctaca

SEQ ID NO: 566 - DNA, 766 bp, Homo sapiens
gagagacaagagtagcggatttcctggggcgactaagaattcctaaacctacctggggaaggggaccgcacccacccttaaacatggggcttgtaactcagctcacacctgaccaatcaggtagtaaaaagggctcactaaaacaccaattaagctaaaagcaagaggtaaagaaatagtcaaatcatctatcatctgagagcacagggggagggacaatgattgggatataaaccccaggcattccagccgggagtgggcaaccccctttgggtccccgcccactgtatgggagctgttttcactctattaaatcttgcagctgcacactcttccacctggagctgagctttcgctcaccgtccaccactgctgttcgccgctgttgcagacccgccgttgacttccacccctctggatccggcagggtgtcccctgcgtttctgatccagcgaggtgcccattgccgctcctgtttgggctagaggctcgccattgttcctgtgcggctaagtgcccgggttggtcctaatcaagctgaacactagtcgctgggttccacggttctcttccgtgacccacgacttctaaaagagctataacactcactgcatggcccaaggtcccattccttgaaatccgtgaggccaagaaccccaggtcagagaacgaaaggcttgctgccatcctgggagcagccgccaccatcttgggagtggcccaccaccatcttgggagctctaagaacaaagacccaccagtaaca

SEQ ID NO: 567 - DNA, 227 bp, Homo sapiens
tagtggtgtacgcagcccccagtcacgtaccccttgcttgctcaatcaatcacgatcctctcatgcagacccccttagagttgtgagcccttaaaagggacaggaattgctcgctcgggttgctcggctcttgagacaggagtcttgccgatgctcctggccgaataaaccccttccttctttaacctggtgtctgaggggttttgtctgcggttcttcctgctaca

SEQ ID NO: 568 - DNA, 430 bp, Homo sapiens
gtcaggcctctgagcccaagcctgcacatatacatccagagggcctgaggcaactgaagaaccataaaagaagtgaaaatggctggttcctgcctcaactgatgacattaccttgtgaaattccttttcctgtctcagaagctcccccactgagcaccttgtgactcccgcccctgcctacaggcgaacaaccccctttgactgtaattttccactacctacccaaatcctataaaactgccccccccaaaactccctttgctgactctcttttcagactcagcccacctgcacccaggcgattaaaaagctttattgctcacacaaagcctgtttagtggtctcctcacatggatgcgcatgacattaggtgccgtgacttggatcgggggacctcccttgggagatcaatcccctgtcctcctgttct

SEQ ID NO: 569 - DNA, 1841 bp, Homo sapiens
aggccttttcaaaactatcaagcagacagtcagggcctgtgaagcgtgccaaagaaataatcccctgccttatcactaagctccttcaggagaacaaagaacaggccattacccaggagaagactggcactagattttacccacatgcccaaatctcagggatttcagtatctactattctgggtagatactttcactggttgggcggagtccttcccttgcaggacagaaaaggcccaagaggtaataaaggcactaattcatgaaataattcccagattcggacttccccgaggtttacagagtgaaaatggccccgctttcaaggctgcagtaacccagggagtatcccaggcattaggcatacagtatcacttacactgcgcctagaggccaaaatcctcaagaacagtcgagaaaatgaacgaaacactcaaacaacatctaaaaaagctaacccaagaaatccaccttgcatggcctgctctgttgcctttagccttactaagaatccgaaactctccccaaagagcaggacttagcccatacgaaatgctgtatggacagcccttcctaaccaatgaccttgtgcttgaccaagagacagccaacttagttgcagacatcacctccttagccaaatatcaacaagttcttaaaacattacagggaacctgtccccaagaggagggaaaggaatttttccaccctagtgacatggtattagtcaagtcccttccctctaacttcccatccctagacacatcctgggaaggaccctacccagtcattttatctaccccaaccgcagttaaagtggctggagtggagtcttggatacatcgcactcgagtcaaaccctggatactgccaaaggaacccaaaaatccaggcgacagtgctagctattcctgtgaatctctagaggatctgcgcctgctcttcaagcaacaaccttgaggaaagtaactagaatcgtagatcctcgtggccctcccttgttgtatttttctttttactgttctcttaccccctttcactctcactgcacctcctccatgctgctgtactaccagtagctccccttaccaagagctcctatggagaatgcagcttcccggaaatattgacgccccatcgtataggggtttttctaaaggaaaccccactttcaccacctacacccatatgcccctgcactttaggccatacatttcaatccctgtatctttaacctccttgttaagtttgtctcttccagaatcaaagctgtaaaacaacacatcgttcttcaaatggagccccagatgcagtccatgactaagatctaccgcggatccctggaccagcctgctagcccatgctccgatgttaatgacatcgaaggcactcctcccgaggaaatctcaaatgcacaacccctactatgccccaattaagcaggaagcagttggagcagtcgacggccaacctccccaacagcacttgggttttcctgttgagagggggtactgagagacaggactagctggatttcctaggccgactaacaatttctaagcttaggtggggaaggtgactgcacctacctttaaacacaggacttttgtaactcagctcacatctggccaatcaggtagtaaagagagctcattaaaataccaattagtctaaaaacaggaggtaaagaaataaatcatctctcgcctgacagcacagaggaaggggcaatgattgggatataaaccccaggcattcgagctgggagtgggcaaccccctttgggtcccctcccattgtatgggagctctgttttcactctattcaatcttgcaactgca

SEQ ID NO: 570 - DNA, 777 bp, Homo sapiens
gagagacaggactagctggatttcctgggccgactaagaatccctaagcctagctgggaaggtgaccacatccacctttaaacacgaggcttgcaacttagctcacacctgaccaatcagagagctcactaaaatgctaattaggcaaaaacaggaggtaaagaaatagccaatcatctattgcctgagagcacagcaggaggggcaaggatggggatataaacccaggcatttgagccagcaacagcaacccctttgggtcccctccctttgtatgggagctctgttttcactctacttcattctattaaatcttgcaactgcactcttctggtctgtgtttgttatggctggagctgagctttcgctcgccatccaccactgttgtttgccgctgtcacagacccgccactgacttccatccctccggatccagcagggtgtccgctgtgctcctgatccagcgaggcgcccattgccactcccgatggggctaaaggcttgccattgttcctgcatggctgagtgcctgggtttgtcctaatcgagccgaacagtagtcactgggttccacagttctcttctgtgacccacggcttctaatagagctgtaacactcaccacatggcccaagattccattccttggcatccgtgaggccaagaacctcatgtcagagaacacgaggcttgccaccatctttgaagcggcccgctgccattttggaagcgcccatcaccatcttaggagctctggaagcaaggaccccccggtaac

SEQ ID NO: 571 - DNA, 5856 bp, Homo sapiens
ctgccttaactgatgacattccaccacaaaagaaatgaaaatggcctgttcctgccttaactgataacattatcttgtgaaattccttctcctggctcatcctggtggctcaaaccctcccctactgagcaccttgtgaccccccctactcctgcctgccagagaacaacacccctttgactgtaattttcctttacctacccaaatcctataaaacggccccacccctatttcccttcgctgactctcttttcggactcagcccgccttcccccaggtgaaataaacagccttgttgctcacacaaagcctgtttggtggtctcttcacatggacacgcatgaaatttggtgccgtgactcggatcgagggacctcccttggaagatcaatcccctgtcctcctgctctttgctccgtgaaaaagatccacctatgacctcgagtcctcagacccaccagcccaaggaacatctcatcaattttcaatccggtaagcggcctcttcttactctcttctccaacctctctcactatccctcaaccactttctcgtttcaatcttggcaccaccccaaccccttacttccatacccctacccctttcccgcttttctggagggtaagaacccccaaaccccttccctccgtgtctctactctctcttttctctaggcttgcttccttcactatgggcaaacttccaccctccattcctccttcttctcccttagcctgtgttctcaagaacttaaaacctcttcaactcacaccagacctaaaacctaaatgccttattttcttctgcaatgctgcttgaccccagtacaaactcgacagtagttccaaatagccagaaaacggcactttcaatttttccatcctacaagatctaaataattcttgtcgtaaaatagacaaacggtctaaggtgcctgacgtccaggcattcttttacacatcagtccctccctagtctctgttccaaatgcaactcatccccaatattccttctttccctcccacctgtcgccccagtcccaaccccaagcatcgctgagtctttctaatcttccttttctacagacccatctgacctctcccctcctcgccaggctgagctaggtcccaattcttcctcagcctccgctcctccaacctataatccttttatcacctcccctcctcacacctggtctggcttacagtttcactccgcgactagccctccccaacttgcccagcaatttcctcttaataaggtggctggagctaaaggcataatcaaggttagtgctcctttttctttattccaaatcagatagcatttaggctctttttcatcaaacataaaaacccagcccagttcatggatcgtttggcagcaactctgagatgctttacagacctagaccctaaaaagtcaaaaggccatcttattctcaatatacattttattacccaatccactcccgacattaaataaaactccaaaaattaaattccggccctcaaaccccacaataggacttaattaacctcgccttcaaggtgtacaatagcagaaaaaagttgcaattccttgcctccactgtgagacgaaccccagccacatctccagcacacaagaacttccaaacacctaaaccacagtggccagttatttctccgggcccacctcccccaggagcttgctacaagtgctggaaatctggccactgggccaaggaatgcccacagcccagaattcctcctcatccacgtcccatctgtgtgggaccccactgaaaatcagacttttcaactcaccaggcagccactcccagagcccctggaactctggcccaaggctctctgactccttcccagatcttcttggcttagcggctgaagacggacgctgcccagtctcctcagaagcccccgagactatcacgaatgccgatcttctggtaacactcacaatggagggtaagtccgtccccttcttaatcaatacggaggctactcactccacattaccttcttttcaagggcctgtttcccttgcctccataactgttgtgggtattgatggccaggcttctaaacctcttaaaactccccaactctggtgccgatttagacatactcttttaagcactcctttttatttattccacctgcccagttcccttattaggccaaggcactaactaaattatctgcttccctgactattcctgggcaacagccacacctcattgccaccttttcccccagttcaaagcctgcttcacatcctccccttctatctccccaccttaacccacaagtataagacacctctactccctccttagcgaccgatcatgcaccctttaccatcccattacaacctaatcactcttcccctgctcaatgccaatatcccatcccacagcatagtttaaaaagattaaagcctgttatcactcgcctgttacagcatggccttttaaagcctataaactctccttacaatgcccctattttacctgtcctgaaaccagacaagacttacagataagttcaggatctgcgccttatcaaccaaattgttttgcctatccaccccttggtgccaaaacccatatagactcctatcctcaatacctccctctacaacccattattctgttctggatctcaaacatgctttctttactattcctttgcacccttcatcccagcctctcttcgctttcacttggactgaccctgacacccattaggctcagcaaattacctgagctgtactgccgcaagacttcacagacagcccccattacttcagtcaatacttcagtcaagcccaaatttcttcctcatctgttacctatctcagcataattctcataaaaacacacgtgctctccctgctgatcgtgttcaactgatctctcaaaccccagcacctctacaaaacaacaactcctttccatcctaggcatggttagatacttttgactttagatacctggttttgccatcctaacaaagccattatataaactcacaaaaggaaacctagctgaccccatagatcctaaatcctttccccactcctctttccgttcattgaagacagctttagagactgtccccaccctagctctccctgacttatcccaacccttttcgttacccacagctgaagtgcagggctgtgcagtcagaattcttacacaagaaccaggaccacaccctgtagcctttatatccaaacaacttgaccttactgttttgcctagccctcaagtctccgtgcagcagccgctgccaccctaatacttttagaggccctaaaaatcacaaactatgctcaactcactctctacagttctcataacttccaaaatctgttttcttcctcacacctgacgcatatactgtctgctccctggctccttcagctgtactcattctttgttaagtctctcacaattaccattgttcctggcacggacttcaatctggtctcccacattattctggttaacacacctgaccctcatgactgtatctctctgatccacctgacattcaccccatttccccatatttccttctttcctgttcctcaccctgatcacatttagtttattgatggcagttccaccaggcctaatcgccactcaccagcaaaggcaggctatgcaatagtatcttccacatctatcattgaggataccgctctgcccccttccagtacctctcagcaagccgaattagttgccttaactcaagccctcactcttgcgaaaagactacgtgtcaatatttatactgactctaaatatgcctttcatattctgcaccatcatgctgttatataggctgaaggaggtttcctcactatgcgaagatcctccagcattaatgcctctttgataaaaactctgctcaaggccgttttacttccaaaggaagctggagtcattcgctgcaaaggccatcaaaaggcgtcagatcccattgctctaggcaatgcttatgctgataaggtggctagacaagcacctagatttccaacttctgcccctcatggccagttttcctccttcacatgggtcactcccacctactcctccgctgaaactaccacctataaatctcttcccacacaaggcaaatggttcttagaccaaggaaaatatctccttccagcctcacaggcccattctattctgtcgtcatttcataacctcttccatgtaggttacaagccgctagcccatctcttagaacctctcatttcctttccatcatggaaatctatcctcaaggagattacttctcagtgttccatctgctattctactacccctcagggattgttcaggcctcctccctttcctacacatcaagctcggggatttgtccctgcccaggactggcaaattgactttactcacatgccccgagtcagaaaactaaaatatatcttagtctaggtagacactttcactggatgggtagaggcctttcccacagggtctgagaaggccatcgctgtcatttcttcccttctgtcagacataattcctcggtttggccttcccacctctatacagtctgataacgggccagcctttattagtcaaatcagccaagcattttctcaggctcttggtattcagtgaaacctttataccccttatggtcctcagtcttcaggaaagctagaatggactaatggtcttttaaaaacacacctcaacaagctcagccaccaacttaaaaaagactggataatacttttaccactttgccttctcagaattcaggcctgtcctcagaatgctacaaggtacagcccatttgagctcctctatggacgctcctttttattaagccccagtctcattccagacaccagaccaacttgcactgtgccccaaaaaacttgtcatccctgctatcttctgtctagtcatactcctattcaccattctcaactactcatacatgctctgctcttgcttacactgccggtttacactgtttctccaagccatcacagctggtatctcctggtgctacctccggactgcaactcttaactcttgaagtaaataaataatctttgctggcaggactatgctgaatctcattaggcactctctaattagatgtcctgggtcctcctaattcttagatctttaatacctgtttttctccttctcttattccatttagtttttcaattcatacaaaacaatatccaggccatcaccaataattctaaatgacaaatgtttcttctaacaaccccacaatatcaccccttaccacaaaatcttccttcagcttaatctctcccactctaggttcccacaccacccctaattccgctggaagtagccctgagaaacatcgccaattatctctccataccatcccccaaaattttcgccgtcccagcactttaccactatttcgttttatttttcttattaatataagaagacaggaatgtcaggcctctgagcccaagctaagccatcatatcccctgtgacctgcatgtacacatccagatggcctattcctgccttaactgatgacatcttgtgaaattccttctcttggctcatcctggctcaaaagctcccctactgagcaccttgtgaccccgccactcctgcccaccagagaacaacccccctttgactgtaattttcctttacctacccaaatcctataaaacggccccacccctatctcccttcgctgactctttttggactcagcccacctgcacccaggtgaaataaacagccttgttgctcacacaaagcctgtttggtggtctcttcacatggatgcgcatgaaa

SEQ ID NO: 572 - DNA, 948 bp, Homo sapiens
gtggggaaaagagagatcagattgttactgtgtctgtgtagaaagaagtagacataggagactccattttgttctgtactgagaaaaattcttctgccttgagatgctgttaatctgtaaccccacccccaaccccctgctctctgaaacatgtgctgtgtccactcagggttaaatggattaagggcggtgcaagatgtgctttgttaaacagatgcttgaaggcagcatgctcgttaagagtcatcaccactccctaatctcaagtaccgagggacacaaacactgcggaagcccacagggacctctgcctaggaaagccaggtattgtccaaggtttctccccatgtgatagtctgaaatatggcctcgtgggaagggaaagacctgaccgtccctcacagcgtgacacccgtaaagggtctgtgctgagaaggattagtgaaagaagaaggaacgcctctttgccgttgaaacaagaggaaggcatctgtctcctgcccgtccctgggcaatggtgtaaaacccgattgtatgttccatctactgagttaggggaaaaccgccttagggctggaggtgggacatgggggcagcaatactgctctgtaaggcattgagatgtttatgtgtatgcatatctaaagcacagcacttagttctttaccttgtctatgacacagagacctttgttcacgtgtttatctgctgaccttctctccactattatcttatgaccctgacacatccccctctccgagaaacacccaagaatgatgaataaatactaagggaactcagaggccggcgggatcctcgtctgctgaatgccggccccctgggctcccttttttctttctctatactttgtgtctctttcttttccaagtctctccttccacctaacgagaaacacccacaggtgtggaggggcaacccaccccttca

SEQ ID NO: 573 - DNA, 964 bp, Homo sapiens
gtggggaaaatagagagagatcagactgttactctatgtagaaagaagtagacataagaaactccattttgttctgtactaagagaaattcttctgccttgagatgctgttaatctgtaaccctagccccaaccctgtgcttgcagagacatgtgctatgttgactcaaggtttaatggatttagggctgtgcaggatgtgctttgttgaaaatgtgtttgaaggcagtatgcttggtaagtcattgccattctctaatctcgagtacccagggacacaatgcattgcagaaggccacagggacctctgcccaggaaagccatgtattgtccaagctttctccccatgtgacagcctgagatatggcctcgtgggaagggaaagacctgaccgtcccccagcacaacacccgtaaagggtctgtgctgaggaggattagtgaaagaggaagaagccctctttgcaattaagaggaaggcatccgtctcctgctcgtccctgggaatggaatgtctcagtgtaaaacaaaatcatacgttctatttactgagataggaaaaaactgtcttatggctggaggtgaaacatgctggcggcaatactgctctttaatgcaccgagatgtttgtgtaaagtcaaacataaatctggcctacgtcctcatcaaggcacagcacctttcctcaaacttatttatgacacagagatctttgctcacatgttttcctgctgaccctctccccaccattaccctatagtcctgccacatccccctctccgagatggtagagatagtgatcaataaatactgatggaactcagagaccagggccggcgcaggtcctctgtatgctaagcgctggtcccctgggcccacagttctttctctatactttgtctctgtgtcttcttttctcactcttttgacccacctgatgagaaacacccacaggtgtggaggggc

SEQ ID NO: 574 - DNA, 784 bp, Homo sapiens
atgctgaacctccttaggcactccctagttagatgtcctaggtcctcccaattcttagtcctttaatacctgtttttctccttgtcttattccgttcttttttcaattcatacaaaaccgtatccaggccatcaccaataattctatatgacaaatgtttcttctaacaaccagaaaatatcaccccttaccacaaaatcttccttcagcttaatctcccccactctaggtttccatgccacccctaatcctgctcgaagtagccccgagaaacatcgcccattctctctccataccaccccccaaaattttcgctgccccaacacttcaacactattatgttttatttttcttattaatataagaagacaggaatgtcaggcctctgagcccaagctaagccatcatatcccctgtgacctgcacatttacatccagatggcctgaagtaactgaagaatcacaaaagaagtgatatttaaatggcctgttcctgccttaactgatgacattccaccacaaaagaagtgaaaatggctggtccttgccttaactgatgacattactttgtgaaattccttctcctggctcatcctggctcaaagtctctctcactgagcaccttgtgaccccccctcctgcctgccagaaaacaaccccctttttcctttacctacccaaatcttataaaacagccccacccctatctcccttcactgactctcttttcggactcagcccacttgcacccaggtgaaataagcaaccttgttgcacacaaaaa

SEQ ID NO: 575 - DNA, 5703 bp, Homo sapiens
gtcaggcctctgagcccaagtcaagccatcacatcccctgtgacttgcacgtatatacccagatggcctgaagtaactgaagaatcacaaaagaagtgaaaatgccctgccccgccttaactgatgacattccaccacaaaagaagtgaaaatggctggtccttgccttaagtgatgacattaccttgtgaaagtcctttccctggctcatcctggctcaaaaagctcccccactgagcaccttgcaaccccccactcctacccacccgagaacaaatcccctttgactgtaattttcctttatctacccaaatcctataaaacatccccactcttatctcccttcactgactctcttttcagactcagcccacctgcacccaggtgattaaaagctttattgctcacacaaagcctgtttggtggtctcttcacacagatgcaagtgaaatttggtgccatgactaggatcgggggacctcccttggcagatcaatcccctgtcctcctgctctttgctccatgaaaaagatccacctacaagctcgggtcctcagacccaccagcccaaggaacatctcaccaattttaaatagggtaagtggcctattcttactgtcttctccaacctctctcactatccctcaaccactttctcctttcaatcttggcaccacccttcaatctctcccttctcttaatttcaattcctttcattttctggtagagacaaaggagacaggttttatctgtggacccaaaactccagcgccggtcatggactcaggaaggcagccttctcttggtgtttaatcattgcagggatacctctctgattattcatctacgtttcagaggtgtctgaccatacagggatgcctgccttggtccttcacccttagcggcaagtcccgcttttctggggggaggggcaaaaaccctgaccccttctctccctgtctctaccccttctctgcttttctggagggaaagaaccccccagccccttatttctgtgccccaacctcttatctctgtgccccaaccccttatttccactcctcaacacctttcccacttttctggagggtaagaacccccaaaccccttctctctgtgtctctactctctctctgggcttgcctccttcactatgggcaagcttccaccctccactcctccatcttctcccttagcctgtgttctcaagaacttaaaacctcttcaactcacactgacctaaaacctaaatgccttattttcttctacaatgccacttgaccccaatacaaactagacagtggttccaaatagccaaaaagttgcattttcgatttttccatcctacaagatctagataattctcatcataaaatgggcaaacggtctgaggtgcctgacatccaggcattcttttacacattgttcccttcctagtctctgttcccaatgcgactcgtcccaaatcctccttccttccctcccgcctatcccctcagtctcaaccccaagcgtcgctgagtctttctaatcttctttttctacagacccatctgacctctcccctccttgccaggctgagccaggtctcaattattcctcagcctcggctcccccaccctataatcctgttatcacctcccctcctcacacctggtccagcttacagtttcattccttgactagctttcccccacctgcccagaaatttcctcttaaaaaggtggctggagctaaaggcatagtcaaggttaattctcctttttctttatccaacctctcccaaaatcagttagtgtttaggctcttttcatcaaatatgaaaaacccagcccagttcatggctcatttggcagcaaccctgagacgctttacagccctagaccctgaaaggtcagaaggccgtcttattctcaatatgcattttattttattacctaatctgttcccgacatgaaataaagctccaaaaattaaattccggccctcaaaccccacaacaggacttaattaacctcaccttcaaggtgtacaataatagaggcagccaagtagcaatgtatttctgagttgcaattccttgcctccactgtgagagaaaccccagctacatctccagcacacaagaactccaaacacctgaaccgcagctgccaggggttcctccagaacctcctccccctggagcttgctacaagtgccagaaatctggccactgggccaaggaatgcccacagcccgggatttctcctaagctgtgtcccatctgtgcaggaccccactgaaaatcggactgttcaactcacctggcagccacttccagagcccctggaactctggcccaaggctctctgactgactccttcccagatcttctcggtttagcagctgaagactgacactgcccgatcgcctcagaggcctacagggccatcacagatgctctaggtaactctcaaagtggaaggtaagtccgtccccttgttaaccaatacggaggctacccactccacattaccttcttttcaagggcctgtttcccttgcctccatacctattgtgggtattgacggccaggcttctaaacctcttaaaactccccaactctggtgccaacttaggcaataccttttaagcacttctttttagttatccccacctgccctgttcccctatcaggccgagacactttaactaaattatctgcttctctgactattcctggggtacagcctcacctcattgccaccttttcccccagttcaaagccttcttcacatcctccccttgtatctccccaccttagcccacaagtataagatacctctactccctccttggcgaccgatcatgcacccctttccatctcattaaaagctaatcacccttaccctgctcaatgctaatatcccatcccacagcacgctttaaaaggattaaattctgttatcactcacctgttatagtatggccttttaaaggctataaactctccttacaattccccccaatttacctgtcctaaaaccagaaaagacttacaggttagttcagtatctgcgccttatcaaccaaattgttttcagcctttctgtccaaacagcttgaccttactgttttagcctagccctcatgtctgcgtgcagcagctgctgctgctttaatacttttgggggccctaaaaatcacgaactatgctcaactcactctctacatttctcataacttccaaaatctattttcttcctcatatctgacacatatactttctgctcccccacttcttcagctatactcactctttattaagtctcccacaattaccattgttcctggcacggacttcaatctggcctcccacattattctggataccacacctgacactcatgactttatctctctgatccacctgacactcaccccatttccccatatttccttctttcctgttcctcaccctgatcacatttagtttattgatggcagttccaccaggcctaatcgccactcaccagcaaaggcaggctatgctatagtatcttccacatctatcattgaggctaccactctgcccccagccccactacctctcagcaagccgaactagttgccttaattcaagccctcactcttgcaaaaggattacgtgtcaatatttatagtgactctaaatacgcctttcatattctgcgccagcatgctgttatataggctgaaagaggtttcctcactatgcaagggtcctccatcattaatgcctttttaataaaagctctgctcaaggccgctttacttccaaaggaagatggagtcattcactgcaaaggccatcaaaaggcatcagatcccattgctctagacaatgcttatgctgataaggtggctagacaagcagctagctttccaacttgtgtccctcacaccagtttttctccttcacatcggtcactcccacctactcccctgctgaaacttccacctatcaatctcttcccacacaaggcaaatggttcttagaccaaggaaaatatctccttccagcctcacaggcccattctattctgtcgtcatttcataacctcttccatgtaggttaaaagctgctagcccctctcttagaacctctcatttcctttccatcatggaaacctatcctcaaggagaccacttctcagtgttccatctgctattctactacccctcagggattgttcaggccccctcccttccctacacatcaaactcggggatttgcccctgcccaggactggcaaattgactttactcacatgccccaaaactaaaatatctgttcgtctgggtagacactttcactggatgggtagaggcctttcccacagagtctgagaaggccaccgcagtcatttcttcccttctgtcagacacaattcctcggtttggccttcccacctctatacaatctgataacggaccagcctttactagtcaaatcacccaagcagtttctcaggctcttggtattcagtggaaccttcatatcccttaccgtcctcaatcttcaggaaaggtagaatggactaatggtcttttaaagacacacctcaccaagctcagcctccaacttaaaaaggattggacagtacttttacctcttgcccttttcagaattagatcctatcctcgagatgctacagggtacagtccatttgaacttttatatggacgccctttcttggttggccccaacctcatcccagacaccagccctctaggcgactatcttccagtcctccaacaggctagacaggaaattcgccaggctgctaatcttctctttcctactccagatccccagccacatgaagacaccctagctggacgatcagttcttgttaagaatctgacccctcaaactctacaacctcgatggactggaccctacttagttatctgtagtaccccaactgctgtctgcctgcaggatcctccccactgggttcaccattccagaataaagctgtgtccattggacagccagcctaatctctcctcttcctcctggaagtctcaagtactctcccctacttcccttaaactcactcatattcatgaaaaacagtaataacccttatgagcctaacacattccttcattctattaggtctgttcgtccttaccctactttttgtaacagggctttacgaagtcacccccaccacttaggccgagccccaaaaagctagtcatccctgctatcttctgtctggtcatactcctattctccattctcaactacttataaatgctttactcttgtttactctgcccagatggcctgaagtaactgaagaatcacaaaagaagtgaaaatgccctgccccgccttaactgatgacattccaccacaaaagaagtgaaaacagccggtccttgccttaagtgatgacattaccttgtgaaagtccttttcctggcttatcctggctcaaaatgctcccccactgagcaccttgtgacccccactcctgcccaccagagaacaaatcccctttgactgtaattttcctttatctacccaaatcctataaaacagccccacccttatctccctttgctgactctcttttcagactcagtctgcctgaacccaggtgattaaaaggtttattgctcacacaaagcctgtttggtagtctcttcacagggacgcaagtgaaa

SEQ ID NO: 576 - DNA, 4011 bp, Homo sapiens
ttctcagcctagcagctgaagactgaggctgcccaatcaccttggaagccctgtagaccatcacggacaccgagctttaggtaactctcacagtggagggtaagtccgtccccttcttaatcaatacggaggctacccactccacattaccttcttttcaagggcctgtttctcttgcctccataactgttgtgggtattgacggccaggcttctaaacctcttaaaactccccaactctggtgccaacttagacaatactattttaagcactcctttttagttatccccacctgctcagttcccttattaggccgagacactttaactaaattatctgcttccctgactattcctggactacagctacatctcattgacacccttcttcccaatccaaagcctcctttgtgtcctcctcttgtatccccccaccttaacccacaagtataggatacctctactccctccttggtgaccaatcatgcaccccttaccatctcattaaaaactaatcacccttaccctactcaacgccaatatcccatcccacagcatgctttagaattattaaagcctgttatcacttgcctgctacagcatggcattttaaagcctataaactctccttacaattcccccattttacctgtcctagaaccgacaagccttacaggttagttcaggatctgcgccttatcaaccaaattgttctgcctatccaccccgtggtgccaaacccatatactctcctatcctccatacctccctccacaacccattattctgttctggatctcaaacatgctttctttactattcctttgcacccttcatcccagcctctcttcgctttcacttggactgaccctgacacccatcaggctcagcaaattacctgggctgtactgccgcaagacttcacagacagcccccattacttcaatcaagcccaaatttcttcctcatctgttacctatctcagcgtaattctcataaaaacacacgtgctgtccctgccaatcctgttcagctgatctctcaaaccccaacacctataaaacaacaactcctttccttcctaggcatggttggatacttttgacttcagatacctggttttgccatcctaacaaaaccattatataaactcacaaaaggaaacctagctgaccccatagatcctaaatcctttccccattcctctttctgttccttgaagacagctttagagactgcccccaacctagctctccctaactcatcccaacccttttcattacccacagctgaagtgcagggctgtgcagtcggaattcttacacaagaaccgggaccgcgccctgtaacctttctatccaaacaacttgaccttactgttttgcctagccctcaagtctgcgtgtggcggctgtcaccaccctaatacttttagaggcccttaaaatcacaaattatgctcaactcactctctccagttctcataacttccaaaatctattttcttcctcacacctgacacatatactgtctgctccccggctccttcagctgtactcactctttgttgagtctcccacaattaccattgttcctggcctgaacttcaatccggcctcccacattattcctgataccacacctgacccccatgactgcatctctctgatccacctgacattcacctcatttccccatatttccttctttcttgttcctccccctgatcacacttggtttattgacggcagttccaccaggcctaatcgctgctcaccagcaaaggcaggctatgcaatagtgtcttccacatctgttattgaggctaccgctctgcccccctccactacctctcagcaagccgaactagttgccttaactcaggccctcactcttgcaaaaggactacacgtcaatatttatactgactctaaatatgccttccatattctgcaccaccatgcagtcatatgggctgaaagaggtttcctcactacacaagtgtccttcatcattaatgcctctttaataaaaactctactcaaggccgctttacttccagaggaagctggggtcattcactgtaaggagcatcaaaaggcgtcagatcccattgctctaggcaatgcttatgctgataaggttgctagacaagcagctagcattccaacttgtgtccctcaaggccagtttttctccttcacatcggtcactcccacctacgcccccgctgaaacttccacctatcaatctcttcccacacaaggcaaatggttcttagaccaaggaaaatatctccttccagcctcacaggcccattctattctgttgtcatttcataacctcttccatgcaggttacaagccgctagcccgcctcttagaacctctcatttcctttccatcatggaaatctatcctcaagaaaatcacttctcagtgttccatctgctattctgctacccctcagggattattcaggcctcctccctttcctatacatcaagctgggggatttgtccctgcccaggagtggcaaattgactttactcacatgccccgagtcagaaaaccaaaatatttcttagtctgggtagacactttcactggatgggtagaggcctttcctacagggtctgagaaggccatcgccgtcatttcttcccttctgtcagacataattcctcggtttggccttcccacccctatacagtctgataacgaaccagcctttattagtcaaatcagccaagcattttttcaggctcttggtattcagtgaaatctttatatcccttacagtcctcagtcttcaggaaaggtagaatggactaaagatcttttaaaaacacacctcaccaagctcagccaccaacctaaaaaggactagacaatacttttaccactttcccttctcagaattccggcctgtcctcagaatgctacagggtacagcccatttaagctcctgtatggacgctcctttttattaggcccagtctcattccagacaccagaccaacttggactgtgtcccaaaaaacttgtcatccctatcttttgtctagtcacactcctattcaccattgtcaactactcatacatgccctgctcttgtttacacttccagtttacactgtttctccaagccatcacagctgatatctcctggtgctaaccccaaactgccactcttaactcttaaataaataatctttgctggcaggactatgctgaatctccttaggcactctctaattagatatcctgggtcctcccaattcttagacctttaatacctgtttttctccttattccgtttagtttttcaattcatacaaaaccatatccaggacatcaccaataattctacatgacaaatgtttcttctatcaaccccacaatatcaccccttaccacaaaatcttccttcagcttaatctctcccactctaagttcccacgccgcccctaatcccactcgaagcagccctgagaaacattgcccattatctctccataccaccccccgaaattttcgccgtcccaacactttaccactatttcgttttatttttcttattaatataagaagacaggaatgtcaggcctctgagcccaagctaagccatcatatcccctgtgccctgcatgtacacatccagatggccggttcctgccttaacctttgacattccaccaaaaagaagtgaaaaatggcctgttcctgccttaactgataacattatcttgtgaaattccttctcctggctcatcctggctcaaaagctcccctactgagcaccttgtgacccccactcctgcctgccagagaacaacccccctttgactgtaattttcctttatctaccaaatcctataaaacggccccacccttatctccctttgctgactctcttttcggactcagcccgcctgcacccacgtgaaataaacagttttattgctcacacaaagcctatttggtggtctcttcacacggacgcgagtgaa

SEQ ID NO: 577 - DNA, 398 bp, Homo sapiens
gtcaggcctctgagcccaagataaaccatcatatccccagtgacctgcatgtatacatccagatggcctgaagtaactaaagaatgacaaaagaagtgaaaatgtattgttcctgccttaactgatgacattaccttgtgaaattccttctcctggctcatcccggctcaaaagctcccccactgagcaccttgtgacccccgcccctgcccagggagaactaccccctttgactgtaattttcctttacctacccaaatgctataaaacggccccacccttatttcccttcactgactctttttcggactcagcccgcctgcacccagatgaaataaactgccctgctgctcacacaaagcctgtttggtgatctcttcacacggacaccagtgaaa

SEQ ID NO: 578 - DNA, 683 bp, Homo sapiens
ttacagttggcagctagtcagacatgagcagtgcaggagaggacaccacctccaccaggaatgtcagacaactataaggtgatggtcaggcaattgttacactgtgtctctaaaataataatcggtggcagccagctccagggaaagacagtctcccaatagaaaaactcctgaaacgtgatcagcagcttcccgataagatctcaggaggtgggcaagtgggctcaagcatgtgcattaagaggaaaaaaggtggcgtttaactggtatatgaccttctgtgaatattcagctagtaagggaagaacacttcaagtgagcatgcatgtttactggagcagttaactccaggaaacacactgtgcatgctctcctcccaagtgctagtaggccactgcacatacagatagcccaccccaagggaagaatctggggagaagggctgcaagacccccaaagtatgccaactccaagccaaaaggtcaaactgtgcacttgatctctcaagtcgcccacttggccctctcccaagggtactttacttcctgttctaaatcattttaataaactttcgctcctgctgtagaacttgccttagtttctccttctgtgttatgccctcagtcgaattctttcatctgatgaggcaagaattgaggttgctgcagactcatatggatatg

SEQ ID NO: 579 - DNA, 398 bp, Homo sapiens
attaggcctctgagcccaaactaagccatcatatcccctgtgacctgcacatatacacccagatggccttaagtaactgaagaatcacaaaagaagtgaaaatggcatgttcctgacttaactgataacattaccttgtgaaattcctttacctggctcatcctggctcaaaagctcccccactgagcaccttgtgaaccccaccgctgcccaccaaagaacaacctcctttgactaattttcctttacctacccaaatcctataaaacggccccacccctatctcccttcactgactctcttttcagactcagctcgcctgcacccaggtgaaataaacagccttgttgctcacacaaagcctgtttggtggtctcttcacatggatgcgagtgaaa

SEQ ID NO: 580 - DNA, 5971 bp, Homo sapiens
gtcaggcctctgagcccaagccaagccatcgcatcccctgtcacttgcacgtacacacccagatggcctgaagtaactgaagaatcacaaaagaagtgaatatgccctgcctcacctcaactgatgacattccaccacaaaagaagtgaaaatggcctgttcctgccttaactgatgacattgtcttgtgaaattccttttcctggctcatcctggctcaaaaacctcccccactgagcaccttgcaacccctacgcctgctcgccagagaacaaaacccctttgactgtaattttcctttacctacccaaatattataaaacggccccacccctatctccctttgctgactctcttttcggactcagcccgcaggcacccaggtgattaaaagctgtattgctcacacaaagcctgtttggtggtctcttcacacggacgcgcatgaaatttggtgccgtgactcagatcgggggacctcccttgggagatcaatcccctgtcctcctgttctttgctccgtgaaaaagatccacctacgacctcaggtcctcagacccaccagcccaaggaacatctcaccaattttaaatcgagtaagcggcctcttcttactctcttcttcaacctctctcactatccctcaaccactttctcctttccactcttcaatctctcccttctttcaatttcaattcctttcattttctggtagagacaaaggagacatgttttatccgtggacccaaaaccccggcgccggtcacagactgggaaggcagccttcccttggtgtttaataattgcagatacgcctctctgattattcacccacgtttcagaggtgtcagatcacgcagggacgcctgccttggtccttcacccttagcggcaagtcccacttttctggggggggcaagtaccccaaccccttctctctgtgtctctaccccgtctccacctttctggggggcaagaaacccctaacccttctccttcactcttagcagcaagtcccgcttttctagaggaggggcaagtaccccaaccccttctctccatgtctctacctcttctccgcctttctggggggcaagaaactcccaaccccttctccttcatccttagcggcaagtcctgcttttctgggggaggggcaagtaccccaaccttgtatctctgcgccccgatcccttatgtccatgccccgacctcttatatctctgtgctccgatcccttatttccacgccccaacctgttatatctctgcgccctgatcccttatttccatgccccgaccttgtatctctgcgccccgacccctttcccacttttctggagggtaagaacccctgaaccccttccctcctgtctctatcttttctctgggcttgcttccttcactatgggcaaccttccaccctccattcctccttcttctcccttagcctgtgttctcaaaaacttaaaacctcttcaactcacatctgacctaaaacctaaatgccttactttcttctgcaatgccacttgaccccaatacaaactcaacagtggtaccaaatagccagaaaatggcactttcaatttttccatcctacaagatataaataattcttgtcgtaaaataggcaaacggtctgaggtgcctgacgtccaggcattcttttacacatcagtcccttcctagtctctgttcccaatgcaactcgtcccaaatcttccttctttccctcccgcctgtcccctcagtcccaaccccaagcatcactgagtctccaatcttccttttctacagatctatctgacctctcccctcctcgccaggccgagctaagtcccaattcttcctcagccccctcttctccaccctataatccttttatcacctcccctcctgacacccggtctggcttacagtttcattccgtaactagccctctgccacctgcctagcaatttactcttaaaaaggtggctggagctaaagacatagtcaaggttaatgctcctttttctttatcccaaatcagatagcgtttaggctctttttcatcaaatataaaaatccagcccagttcatgactcgtttggcagcaaccctgagactctttacagccctagaccctaaaacatcaaaaggctgtcttattctcaaaatacattttattacccaatctgctcccaacattaaataaaactccaaaaattaaattctggccctcaaaccccacaacgggattaattaacctcgccttcaaggtgtacaataatagaaaaaagttgcaattccttgcctccactgtgagacaaaccccagccacaactccagcacacaagaacttccaaatgcctgaaccgcagcggccaggcgttcctccagaacctcctctgccaggagcttgctacaagtgccagaaatctggccaccaggccaaggaatgcctgcagcccaggattcctcctaagtcacgtcccatctgtgcaggaccccactggaaatcggactgtccaactcacctggcagccactcccagagcccctggaactctggcccaaggctctctgactgcttcccagatcttcttggcttagcggctgaagactgacactgcctgatcacctcggaagccccctagaccatcacggactccgagcttcgggtaaccttcacagtggaaggtaagtccgtccccttcttaatgaatacggaggctacccactccacattacctccttttcaagggcctgtttcccttgcctccataactgttgtgggtattgacggccaggtttctaaacctcttaaaactccccaactctggtgccaccttagacaatactcttttaagcactcctttttagttatccccacctgcccagttcccttattaggccaagacactttaactaaattatctgcttccctgactattcctgggctacagccacatctcattgccaccttttcccccacttcaaagcctccttcacatcctcctcttgtatccccccaccttaacccacaagtataggatacttctactcccttcttggtgaccgatcatgcaacccttaccatctcattaaaatctaatcacccttaccccactcaacgccagtatcccatcccacagcacgctttaaaaagattaaagcctgttatcactcgcctgctacagcatggccttttaaagcctataaactctccttacaattcccccattttacctgtcctaaaaccagacaagccttacaagttagttcaggatctgtgccttatcaaccaaattgttttgcctatccaccccatggtgctgaacccatatactctcctatcctcaatacctccctctacaacccattattctgttctagatctcaaacacgctttctttactattcctttgcacccttcatcccagcctctcttcgctttcacttggactgaccctgacacccatcacgctcagcaaattacctgggctgtactgccgcaaggcttaacagacatcccccattacttcagtcaagcccaaatttcttcctcatctgttacctgtctcggcgtaattcttagaaaaacacatgtgctctctctgccgatcgtgtctgactgatctctcaaaccccaacaccttctacatcctaggcatggttagatactttcgactttagatacctggttttgccatcctaacaaaaccattatataaactcacaaaaagaaacctagctgaccccatagatcctaaatcctttccccactcctttttccgttccttgaagacagctttagagactgccccaacccgagcgctccctgactcatcccaacccttttcattacacagagctgaagtgcagggctgtgcagtcggaattcttacacaaggaccgggatcgcgtcctgtagcctttttgtccaaacaacttgaccttactgttttaggctggccatcatgtctccgtgcagtggctgctgccaccccaatactttcagaggcccttaaaatcacaaactatgctcaactcactctctacagctctcataatttccaaaatctattttcttcctcacacctgatgcctatactttctgctccccagctccttcatctctctgatccacctgacgttcaccccatttccccacatttccttctcccctgtttctcaccctgatcacacttagtttattgatggcagttccaccaggcgtaatcgccacacaccagcaaaggcaggctatgctatagtacaagccactagcccgcctcttagaacctctcatttcctttccattgtggaaatctatcctcgaggaaataacttctcagtattccatctgctatgctactactcctcagggattattcaggccccctctcttccctacacatcaagttcagggatttgcccccgcccaggactggcaaattagctttactcaacatgccccgagtcaggaaactaaaatacctcttattctaagtagacactttcactgaataagtaaaggcctttcctacagggtctgagaaggccaccgtagtcatttcctcccttctgtcagacataattccttagtttagccttcccacctctatacagtctgataacagaccagcctttattagtcaaatcagccaagtagtttttcaggctcttagtattcagtgaaacctttacatcccttacagtcctctgtcttcaggaaaagtagaacagactaaaggtcttttaaaaacacacctcaccaagctcagccaccaacttaaaaaggactggacaatacttttaccactttcccttctcagaagtcagacctgtcctcagaatgctacagggtacagcccatttgagctcctgtatagacgctcctttttattaggccccagtctcattccagacaccagaccaacttagactgtgccccaaaaaaacttgtcatccctactatcttctgtctagtcatactcctattcaccattctcagctactcatacatgccctgctcttgtttacactgccggtttacactgtttctccaagccatcacagctgatatctcctggtgctatccccaaactgccactcttaactcttgaagtaaataaataatctttgctggcaggactatgctgaatctccttaggcactctctaatcagatgtcctgggtcctcccaattcttagaccttttatacctgtttttctccttctcttattccatttagtttttcaattcatacaaaaccatatccaggccatcaccaatcattctatacaacaaatgtttcttctaacaaccccacaatatcaccccttaccacaaaatcttccttcagcttaatctctcccactctaggttcccaagccaccccaatcctgctcgaagcagccctgagaaacatcgcccattctctctctccataccaccccccaaaaattttcgccaccccaacacttcaacactattttgttttatttttcttattaatataagaaggcaggaatgtcaggcctctgagcccaagccaagccatcgcatcccctgtgacttgcacatattcgcccagatggcctgaagtaactgaagaatcacaaaagaagtgaatatgccctgccccgccttaactgatgacattccaccacaaaagaagtgaaaatggcctgttcctgccttaactgatgacattgtcttgtgaaattccttttcctggctcatcctggctcaaaaacctcccccactgagcaccttgcaacccccactcctgcccgccagagaacaaaccccctttgactgtcattttcctttacctacccaaatcttataaaacggccccacccctatctccctttgctgactctcttttcagacttagcccgcctgcacccaggtgattaaaagctgtattgctcacacaaagcctgtttggtggtctcttcacacggacgcgcatgaaa

SEQ ID NO: 581 - DNA, 6034 bp, Homo sapiens
gtcaggcctctgagcccaagctaagccatcatatcccctgtgacctgcacatacacatccagatggccaattcctgccttaactgatgacattccaccacaaaagaagtgaaaatggcctgttcctgccttaactgatgacactgtcttgtgaaattccttctcctggctcatcctggctcaaaagctcccccactgagtacctggcgactctcactctgcctgccagagaaaaactcccctttgactgtaattttcctttatctacccaaatcttataaaatggccccacccttatctccctcccctgactttcttttcagactcagcccacctgcaccaggtgaaataaacagccatgttgctcacacaaagcctgtttggtggtctcttcacacagacgtgcatgaaatttggtgctgtgactcggatcgggggacctctcttgggagatcaatcccctgtcctcctgctctttgctccgtgagaaagatccacatatgacctcaggtccttaaaccaaccagcccaagaaacatctcaccaatttcaaatccagtaagcggcctctttttactctcttctccaacctccctcactatcccttaacctctttctcctttcaatcttggtgccacacttcagtctctcccttctcttaatttcaattcctttcattttctggtagagacaaaggagacacattttatctgtggacccaaaactctggcgccggtcacggactagggaaggcagccttccctgggtgtttaatcattgcagggacacctctctgattattcaccaaagtttcagaggtgtcagaccacgcagggatgcctgccttggtccttcacccttagcggcaagtcccgcttttctggggaaggggcaagtaccccaaccccttctctccctgtctctaccacttcttcacctttctagggggcaagaaacccccaaccccttcttcacccttagcagcaagtcccacttttctaggggagaggcaagtaccccaaccccttatatctctctgccccgatcccttaattccgtgccccaaccccttatatctctgtgccccgatccctaatttccgcaccccaaccccttatatgtctgcgccctgatcccttatttccgtgccctgacctcatatctctgtgcctcgacccctttcccacttttctggagggtaagaacccccgaaccccttccctccctgtctctactctctcttttctctaggcttgcctccttcactataggcaaccttccaccctccattcctccttcttctcccttagcctgtgttcttaagaacttaaaatctcttcaactcttacctgacctaaaatctaagcaccttattttcttctgcaacaccgcttggccccaatacaaacttgacaatggctctaaatggccagaaaatggcactttcgatttctccttcctacaagacctaaataatatttgtcgaaaaatgggcaaatagtctgaggtgccttgcgtccaggcatttttcacacttcgttccctccctagtctctgttcccaatgcgattcctcccagatcctccttctttccctcccgcctgtcccctcagtcccaaccgcaagtgtcactgaatctttcaagtcttcctttcctacagacccatctgacctttcctctcttccccaggctgctcgtcgccaggccgagctaagtcccaattcctcctcagcctccgctcctccaccctatgatccttctaccacctaccctcctcacacccggtccggcttacagcttagttccgtgactagttcttccccacctgcccaacaatttcctcttagagaggtggctggagctgaaggcatagtcagggtacatgtacctttttctctatcagacctctctcagatcagtcagtgtttaggctctttctcatcagaccccactaaatatgtacaggaattccaatatctaactctgtcctgcaatttaacctggagtgacttaaatatcatcctgacttctaccctctccccagatgaacaggaaagagttttttccctagcccaatctcacgctgataaccgctggcttcatgagccagacctccaggaaggcattagagcagttccccaagaagatccccaaaggaactaccaggcaaattccccaggtatagctaggcgagattacatggtttcctgcctagttgaaaggcttaaaaaggcagcttacaaagctgttaattatgacaagcttcaagaaactacccgaggtaaagatgaaaacccagcccagttcatggcccgcttagcggcaacccttagacgctttaccaccctagacccagaggggccagaaggccgccttattcttaatatacattttattatccaatctgctcccgacattaaataaaactccaaaaattaaattccggccctcaaaccccacaacaggatttaattaacctcgccttcaaggtgtacaataatagaaacaagttgcaattccttgcctccactgtgagacaaaccccagccacatctccagcgcacaagaacttccaaatgcctgaaccgcagtggccaggcgttcctccagaacctcctcccacaggagcttgctacaagtgtcagaaatctgaccaccaggccaaggaatgcctgcagcccaggattcctcctaagccacgtcccatctgtgcaggaccccactggaaatcggaccgttcaactcacctggcagccactcccagagcccctggaactctggcccaaggctctctgactccttcttggcttagcggctgaagactgacgctgccggatcgcctcggaagccccacagaccatcacggatgccgagcttcgggtaactctcacagtggaaggttaagtccgtccccttagtcaatacggaggctacccactccacattaccttcttttcaagggcctgtttcccttgcctccataactgttgtgggtattgacggccaggcttttaaacccctgaaaactcccccactctggtgccaacttggacaacactcttttatgcactcttttttaattatccccacctgcccagttcccttattaggctgagatattttaaccaaattagctgcttccctgactatttctaggctacagccacacctcattgccaccttttccctagttcaaagcttccttcacatcctcgtctcatatccctccaccttaacccacaagtataagatacctctattccctccttggtgaccaatcacacaccccttacaatctcattaaaacctaatcacccttacttccctcaatgccaatatcccatcccacagcacaccttaaaaagattaaagcctgttatcactcgcctgctacagcatggccctttagagcctataaactctccttacaattcccccattttacctgtcctaaaaccagacaaggcttacaggttagttcagaatctgcgccttatcaaccaaattgttttgcctatccaccccgtggtgccaaacccgtatactctcctatcctcagtacctccctctacaacccattattctgttctagatctcaaacatgctttctttactattcctttgcacccttcatcccagcccctcttcgctttcacctagactgaccctgacacccattaggctcagcaaattacctgggatgtactgccgcaaggcttcacagacagaccccattacttcagtcaagaacaaatttcatcctcatctgttacctatctcagcataattctcataaaaacacacgtgctctcccgctgatcgtgtccaattaatctcccaaacctcgatcccttacaaaacaacaactcctttccttcctaggcatggttagtgcggtcagaattcttacagaagagccaggaccacaccctgtagcctttctgtccaaataacttaaccttactgttttagcctagccctcatgtctgcgtgcagcagctgccgctgcattagtacttttagaggccctaaaaatcacaaactatgctcaactcactccctacatttctcataacttccaaatctattttcttcctcatacttgacgcatatactttctgctccccggctccttcagctgtactcactctttgttaagtcccacaattaccattatgcctggcccggacttcaatccggcctcccacattattcctgataccacacctgacccccatgactgtatctctctgatccacctgacattcaccccatttccccatatttccttctttcctattcctcaccctgatcacgcttgatttattgatggcagttccaccaggcctaatctccacacaccagcaaaggcaggttatgctatagtacaagccactagcccgcctctttgaacctctcatttcctctccatcgtggaaatctatcctcaaggaaataacttctcagtgttccatctgctattctactactcctcaaggattattcaggccccctcccttccctacacatcaagctcgaggatttgccccacccaggactggcaaattagctttactcaacatgccccgagtcagataactaaaatacctcttagtctaggtagacactttcactggataggtagaggcctttcctacagggtctgagaaggccactgcagtcatttcttcccttctgtcagacataattcctcagtttagccttcccacctcaatacagtctgataacagacctgcctttattagtcaaatcagccaagcagtttttcaggctcttggtattcagtgaaacctttatatcccttacagtcctcagtcttcaggaaaagtagaacggactaaaggtcttttaaaaccacacctcaccaagctcagccaccaacttaaaaaggactggacaatccttttaccaccttcgcttctcagaattcaggcctgtcctcggaatgctacagggtacagcccatttgagctcctgtatagacgctcctttttattaggccccagtctcattccagacaccagaccaccttagactgtgccccaaaaaaacttgtcatccccactatcttctgtctagtcatactcctattcaccgttctcaactactcatacatgccctgctcttgtttacactgccagtttacacagtttctccaagccatcacagctgatatctcctggttctatccccaaactgccactcttaactcttgaagtaaataaataatctttgctggcaggactatgctgaatctccttaggcactgtctaatcagatgtcctgagtcgtcccaattcttcgatcttttatacctgtttttctccttctcttcttccatttagtttttcaattcatagaaaactgtatccaggccatcaccaataattctaaatgacaaatgttccttctaacaaccccacaatatcactccttaccacaaaatcttccttcagcttaatctctcccactctaggttcccacaccaccccaatcccgcttgaagcagccctgagaagcatcgcccattatctctccataccacccccaaaaattttcactgtcccaacacttcaacactatttcattttatttttcttattaatataagaagacaggaatgtcaggcctctgagcccaagctaagccatcatatcccctgtgacctgcacatacacatccagatggccgattcctgccttaactgatgacattccaccacaaaagaagtgaaaatggcctgttcctgccttaactgatgacattgtcttgtgaaattccttctcctggctcatcctggctcaaaagctcccccactctgcccgccagagaacaactcccctttgactgtaattttcctttatctacccaaatcctataaaatggccccacccttatctcccttccctaactctcttttcggactcagcccacctgcacccaggtgaaataaacagccatgctgctcacacaaagcctgtttgctggtctcttcacacggatgcacatgaaa

SEQ ID NO: 582 - DNA, 5801 bp, Homo sapiens
gtcaggcctctgagcctaagctaagccatcatatcccctgtgacccgcacgtacacatccagatggccggttcctgccttaactgatgacattccaccacaaaagaagtgaaaatggcctgttcctgccttaactgatgacattgtcttgtgaaattccttctcctggctcatcctggctcaaaagctcccctactgagcaccttgtgacccccactctgcccgccagagaacaaccccctttgactgtaattttcctttatctacccaaatcctataaaacggccccacccttatctccttttgctgactctcttttcggactcagcccacctgcacccaggtgattaaaagctttattgctcacacaaagcctgtttggtggtctcttcacatggacacgcatgaaatttggtgccgtgactcagatcgggggacctcgcttgggagatcaatcccctgtcctactgctctttgctccgtgagagaggtccacctatgacctcaagtcctcagaccgaccagcccaagaaacatctcaccaatttcaaatccggtaagcggcctctttttactctcttctccaacctccctcactatccctcaacctctttctcctttcaatcttggcaccacacttcaatatctcccttctcttaatttcaattcctttcattttctggtagagacaaaggagacacgttttatccatggacccaaaactctggcgccagtcacggactagagaaggcagccttcccttggtgtttaatcattgcagggatgcctctctcattattcacccaggtttcaaaggtgtcagaccatgcaaggatgcctgccttggtccttcacccttagcagcaagtcccacttttctaggggaggggcaagtaccccaacccctactctctgtgtctctaccccttctccgcctttctggggggcaagaaacccccaaccccttctccttcactcttagtggcaagtcccacttttctaggggaggggcaagtaccccaaccccttctgtgtcgctaccccttctccgcctttctgggaggaaaaaacccccacaaccccttctccttcccccttagcagcaagtcccgcttttctgggggaggggcaagtaccccaacctcatagctgtgcgccccgatcccttatttctgcacccccacctctaatatctctgtgccctgatcccttatttccgtgtcctgaccttgtatctctgcgccccgacccctttcccgcttttctggaaggtaagaacccccgaactgcttccctccatgtctctactctcccttttctttaaacttgcctccttcacgataggcaaccttccaccctccattcctcctccttctcccttagcctgtgttcttaagaacataaaacctcttcaactctcgcctgacctaaaacccaaatgccttattttcttctacaatgctgcttgaccccaatacaaactcgacagtagttctaaatggccagaaaacggcactttcgatttctccatcctacaagacctaaataatttttgttgaaaaataggcaaatggtctgaagtgcctgacgtccaggcattcttttacacatcagtccctccctagcctctgtgcccagtgcaactcgtcccaaatcttccttctttccctcccgcctgtcccctcagtcccaaccccaagcatcgctgagtctttctaatcttccttttctacagacccatctgacctctcccctcctccccaggctgctcctcgccaggccgagctaggtcccaattcttcctcagcctccactcctccaccctataatctttttatcacctcccctcctcacacctggtcccgtttacagtttcattccgtgagtagccctcccctacctgcccagcaatttcctcttaaaaaggtggctgaagctaaaggcatagtggaagttaatgctcctttttctttatcagacctctcccaaatcagtgagtgtttaagctctttcatcaaatatgaaaaacccagcccagtttatggctcgttcggcagcaaccctgagatgctttacagccctagaccctaaaaggtcaaaaggccgtcttattctcaatatacattttattacctaatctgctcccggcattaaataaaactccaaaaattaaattccggccctcaaaccccacaacaggacttaattaacctcaccttcaaagtgtacaataatggagtagaggcagccaagtagcaatgtatttctgagttgcaattccttgcctccactgtgagacaaacccgtcacatctccagcacacaagaactccaaacgcctgaaccacagctgccaggggttcccccagaacctccttccccaggagcttgctacaagtgccagaaatctggccactaggccaaagaatgcccacagcccaggattcctcctaagccatgtcccatctgtgcaggatcccactgaaaactggactgttcaactcacctggcagccacttccagagcccctagaactctagcccaaggctctctgactgactccttcccagatcttctcagcttagcagctgaagactgacactgcccgatcacctcagaagcctacaagactatcacagatgctctaggtaactctcacagtggaaagtaagtccgtccccttcttaatcaatacggaggctacccactccacattaccttcttttcaaaggcctgtttcccttgcctccataactgttgtgctattgacggccaggcttctaaacctcttaaaactccccaactctggcgccaacttagacaatactcctttaagcactcctttttagttatccccacctgcccagttcccttactaggccgagacactttaactaaattatctgcttccctgactattcctgggctacagccacacctcattgccaccttttcccccagttcaaagcctccttcacatcctccccttgtatctccccaccttaacccacaagtataagatacctctactccctccttagtgaccgatcatgcatcccttaccatctcattaaaacctaatcacccttaccccgctcaatgccaatatcccatcccacagcacgctttgaaaggattaaagcctgttatcactcgcctgctacagcatggccttttaaagcctatgaactcttcttaccattcccccattttacctgtcctaaaaccagacaagccttacaagttagttcagaatctgcaccttatcaaccaaattgttctgcctatccacccgtggtgccaaacccatactcaatacctccctctactacccattattctgttctagatctcaaacatgctttctttactattcctttgcacccttcatcccagcctctctttgctttcacttagactgaccctgacacccattaggctcagcaaattacctcggctgtactgccgcaaggcttcacagacagcccccattacttcagtcaagcccaaatttcatcctcatctgttacctatctcagcataattctcataaaaacacacgtgctctccctgctgatagcgtccaattaatctcccaaacctcaatcccttacaaaataacaactcctttccttcctaggcatggttagtgcggtcagaattcttacacaaaagccaggaccacaccctgtagcctttctgtccaaacaacttgaccttactgttttagcctagccctcatgtctgcgtgcagcggctgccgctgctttaatacttttagaggccctaaaaatcacaaactatgctcaactcactctctacatttctcataacttccaaaatctattttcttcctcatacctgacgcatatactttctgctccccggctccttcagctgtactcactctttgttaagtcccacaattaccattgtttctggcccagacttcaatccggcctcccacattattcctgataccacaccatgactgtatctctctgatccacctgacattcaccccatttccccatatttccttctttcctgttcctcactctgatcatgcttgatttattgatggcagttccaccagccctcatcaccacacaccagcaaaggcaggctatgctatagtacaagccactagcccgcctcttagaacctctcattttctttccatcatggaaatctatcctcaaggaaataacttctcagtgttccatctgctattctactactcctcagggattattcaggccccctcccttccctacacgtcaagctcaaggatttgcccccacccaggactggcaaattagctttactcaacatgccctgagtcagataactaaaatacctcttagtctaggtaggcactttcactggataggtacaggcctttcctacaaggtctgagaaggccaccgcagtcatttcttcccttctgtcagacataattcctcagtttagccttcccacctctatacagtctgataacagcccagcctttactagtcaaatcagccaagcagcttttcaggctcttagtattcagtgaaacctttatatcccttacagtcctctgtcttcaggaaaagtagaacggactaaaagtcttttaaaaacacacctcaccaagctcagccaccaacttaaaaaggactggacaatacttttaccactttcccttctcaaaagtcagacctgtcctcagaatgctacaaagtacagcccatttgagcttctgtatagacgctcctttttattaggccccagactcatttgacgccagaccaacttaaactgtgccccaaagaaacttgtcatccctactaccttctttctagtcatactcctattcaccgttctcaactactcatacatgccctgctcttgtttacactgccggtttacatggtttctctaagccatcacagctggtatctcctagtgctatccccaaactgccactcttaagtcttgaagtaaataaataatctttgctggcacgactatgctgaatctccttaggcgctctctaatcagatgtcctaggtcctcccaattcttagacctttaatacctgtttttctccttctcttattccgtttagtttttcaattcatacaaaactgtatccaggccatcaccaataattctaaatgacaaatgtttcttctaacagtcccacaatatcaccccttaccacaaaatcttccttcagcttaatctctcccactctaagttcccacgccgcccctaatcccgctcgaagcagccctgagaaacatcgcccattctctctccataccatcccccaaaatgttcactgtcccaacactttaccactattttgttttatttttcttattaatatgagaagacaggaatctcaggcctctgagcccaagctaagccatcatatcccctgtgacctgcatgtacacatccagatggccagttcctgccttaactgatgacattccaccacaaaagaagtgaaaatggcctgttcctgccttaactgatgacattgtcttgtgaaattccttctcctggctcatcctggcccaaaagctcccctactgagcaccttgtgacccccactctgcccgccagaggacaaccccctttgactgtaattttcctttatctacccaaatcctataaaacggccccacccttatctcctttcgctgactctctttttggactcagcctgcctgcacccaggtgattaaaagctttattgctcacacaaagcctgtttagtggtctcttcacatggacgcgcatgaaa

SEQ ID NO: 583 - DNA, 7483 bp, Homo sapiens
gttaggcctctgagcccaagctaaggcatcgcatcccctgtgacctgcacatatacacccagatggcctgaagtaactgaagcatcacaaaagaagtgaaaatggcctgttcctgccttaactgatgacattccaccacagaagaagtgaaaatggctggtccttgccttaagtgatgacattaccttgtgaaattccttttcctggttcatcctggctcaaaaaagctcccccactgagcaccttgtgatccccactcctgcccaccagagaacaaccccactttgactgtaattttcctttacctacccaaatcttataaaatggccccacccctatctcccttcactgactctcttttcagactcagcccgcctgcacccaggtgattaaaaagctttattcctcacacaaagcctgtttggtggtctcttcacacgaacgcgagtaaaatttggtgccgtgactcggattgggggacctcccctgggagatcaatcccctgtcctcctgctctttgctccgtgagaaagatccacctacgacctcaggtcctcagaccaacctgcccaaggaacatctcaccaattttaaatctggtaagcagcctctttttactctcttctccaacctctctcactatccctcaacctctttctcctttcagtcttggcaccacacttcaatctctcccttctcttaatttcagttcctttccttttctggtagagacaaaggagacgtgttttatccgcggacccaaaactccggcgccggtcatggacttgggaaggcagccttaccttggtgtttaatcattgcagggatgcctgcctgattattcacccacgtttcagaggtgtctgaccatgcagggacgcctgccttggtccttcacccttagtggcaactaccgcttttctggagggcaagaacccccgaccccttctttccatgtctctactctctcttttctctgggcttgcctccttcactatgggcagccttccacctccattcctccttcttctcccttagcctgtgttctcaagaacttaaaacctcttcaactcacagctgacctaaaacctaaacaccttattttcttctataatgccgcttcaccccagtacaaacttgacagtggttccaaatagccagaaaactgcacttctgatttttccatcctacaagatctagataattgttgtcataaaataggcaaacggtctgaggtgcctgacatccaggcattcttttacacattgttccctccttactctctgttcccaatgcgacttgtcccagatcctccttctttccctcccgcctgtcctctcagtcccaaccccaagtgtcgctgagtctttctaatcttccttttctatatacccatctgacctctcccctcctccccaggctgctcctcgccaggtcccaattcttcctcagcctctgctcccccaccctataatccttttatcacctcccctcctcacacccagtctggcttacaatttcgttccgtgactagccctcccccacctgcccagcaatttcctcttaaaaaggtggctggagctaaaggcatagtcaaggttaatgctcctttttctttatccaacctctcccaaatcagttagtgtttaggctctttcaacaaatatgaaaaacccagcccagttcattgctcgttcggcagcaaccctgagacgctttacagccctagaccctgaaaggtcagaaggccatcttattctcaatatgcattttattttattacccaatctgctcccaacattaaataaagctccaaaaattaaattccagccctcaaaccccacaacaggacttaattaacctcaccttcaaggtgtacaataataaagtagaggcagccaagtagcaatgtatttctgagttgcaattccttgcctccactgtgagacaaaccccagccatatctccagcacacaagaactccaaatgcctgaaccatagctgccaggggttcctccagaacctcctcccccaggagcttgctacaagtgctggaaatctggccactgggccaaggaatgcccacagaccaggattcctcctaagccatgtcccatctgtgcaggaccccattgaaaatcggactgttcaactcacctggcagccactcccggggtccctggaattctggcccaaggctctctgactccttcccagattttcttggcttagcggctgaagactgacactgcccgatcgccttggaagcccctagaccatcacgggcgccaagcttcaggtaactctcacagtggagggtaagtccatccatcctcttcttaatcaatacagaggctacccactccacattaccttcttttcaaaggcctgtttcccttgcctccataactgttgtgggtattgacggccgggcttctgaacttcttaaaactccccaactctggtgccaacttagacaataatctttcagcactccttttagttatccccacctgcccagttcccttattaggctgagatattttaactaaattatctgcttccctgactattcttgggctacagccacatctcactgccgcccttcttcccaacccaaagcctcccttgcgtcttcctctcgtatccccccctccttaacccacaagtataggacatctctactccctccctggcaaccaatcacatgcccattaccatcccattaaaacctaatcacccttaccccgctcaatgccaatatcccatcctacagcatgctttaaaaggattaaagcctgttatcactcgcctgctacagcatagccttttaaagcctgtaaactccccttgcagttaccccatttcacctgtcctaaaaccagacaaagcttacaggttagttcagaatctgcgtcttatcaaccaaattgttttgcctatccaccctgtggtgccaaacccatatattctcctatcctcaatacctccctccataatccattattctgttctggatctcaaacatgctttctttactattcctttgcacccttcattccagcctctctttgctttcacttggactgacccgacagccatcaggctcagcaaattacctaggctgtactgctgcaaagcttcacagacagcccccattacttcagtcaagcccaaatttcttcctcatctgttacctatctcagcataattatcataaaaacacatgtgctctctctgctgatcatgtccggctaatctcccaaaccccaatcccttctacaaaacaacaactcctttccttcctaggcatggttagtgtggtcagaattcttacacaacagccagaaccgcgccctatagctttctgtccaaacaacttgaccttactatttcagcctagccctcatgtctgtgtgcagccgctgctgctgccttaatacttttagaggccctcaaaatcacaaactatgctcaactcactctctacagttctcataacttccaaaatctattttcttcctcatacctggtgcatatactttctgcttcccagctccttcagctgtactcactctttgttgagtctcccacagttaccattgttcctggcccggacttcaatccggcctcccacacctgaccctcatgactgtatctctctgatccacctgacattcactccatttccccatatttccttcttccctgttcctcaccctgatcatatttggtttattgatggcagttccaccaggcctaatcaccacacaccagcaaaggcaggctatgctatagtacaagccactacccgcctcttagaacctctcatttcctttccactgtggaaatctatcctcaaagaaatcacttctcaatgatcgatctgctattctactacccctcagggattgttcaggccccgtccctttcctacacatcaatctcagggatttgcccccacccaggactggcaaattgactatactcacatgccccaagtcagaaaactaaaatacctcttagtctgggttgacactttcactggatgggtagaggcctttcccacagggtctgagaaagccaccgcagtcatttcttcccttctgtcagacagacataattcctcggtttggccttcccacctctatacagtctgataatggatcggcctttactagtcaaatcacccaagcagtttctcaggctcttggtattcagtggaaccttcatatcccttaccgtcctccatcttcaggaaaggtagaacagactaatgttgttttaaagacacacctcaccaagctcagcctccaacttcaaaaggattaggcagtacttttacctcttgcccttcttagaattagagcctgtcctcgagatgctacagggtacggtccatttgaacatttatatggatgcactttcttgctcagccccaacctcatcccagacaccagccctctaggcaactatcttccagtcctccaggaggctagacaggaaattcaccaggctgctaatctcttgcctactccagattcccagcaatatgaagacaccctagctggacgatcagttcttgttaagaatctgacccctcaaactctactacctcgaaggaccggaccctacttagtcatctgtagtaccccaactgccgtctgcctgcaggatcctccccactgggtttaccattccagaataaagctgtgtccatcggacagccagcctaatccctcctcttcctcctggaagtcgcaagcactctcccctacttcccttaaactcactcgtatttctgaagaacagtagtaacccttatgagcctaacacatcccttcattctattaggtctgttcatccttaccctactttttgcaacagggctttacaaagtcacccccactactaggaccgagccccaaaaactagtcatccctactatcttctgtctagtcatactcctattctccattcttaactacttataaatgccctactcttgtttacactgctggtttacactgtttcttcaagccatcacagctgatatttcttagtgctatccccaaaacaccactcttaactctctcttagagcagatagatgatctttgctggcaggggactctccaatactttcaccctgatgaagttctattctttacttttatactgactcttttcgtcattcccattcttatgccaccctctacctctccccagctctctccaccacactatcaaccttacccattctctcctagctgtttctaatccctcctcatcgaacaactgctagctttgcatttccctttcttccagcgtctacacagctgtccccgccttacatgcagactgggcaacatctcctgtctccttacacctccgaacttcctttaacagccctcacctttaccctcctgaagaactcatttactttctagacaggtgcagcaagacctccccagacatttcacatcagcaagctgctgacctcctccacacttacttaaaaaacctttctccttatatcaactctactccccctatatttggacctctcacaacacaaactactattcctatggccgctcctttatgtgtctctcggcaaagacacactggaattcccctaggtaacctttcaccttcttgatgttcctttactcttcatctccagagcccaactacacacatcactaaaactgttggagccttccagctccatattacagacaagccctctatcaatactggcaaacttaaaaacattagcagtaattattgcttaggaagacacttaccctgtatttcactccatccttagctaccttccgcttgctcgtcagactctcctcccaggccctcttcttgtttacttatacccagccccaaaaataacagtgaaaggttgctcgtagatactcaacattttctcatacaccatgaaaatcaaaccttcccctctatgcagttaccccatcagtccccattacaacctctgacggctgccgccctagctggatccctaggagtctgggtacaagacatccctttcagcactccttctcatctttttactttgcaactccagttttgcctcgcacaaggtctcttcttcctctgtggatcctctacctacatgtgtctacctgttgattggacaggcacatgcacactagttttccttgctcccaaaattcaatttgcaaatgggaccgaagagctccctgttcccctcatgacactgacatgacaaaaaagagttattccattaattcccttgcttgtcggtttaggactttctgcctccactattgctctcagtactggaatagcaggcatttcaacctctgtcatgaccttctgtagcctctctaatgacttctctgctagcatcacagacatatcgcaaactttatcagtccctacaggcccaagttgactctttagctacagttgtcctccaaaaccgctgaggccttgatttactcactgctgaaaaaggaggactctgtatattcttaaatgaagagtgttgtttttacctaaatcaatccagcctggtgtatgacaacataaaaaaactcaaggatagagcccaaaaacttgccaaccaagcaagtaattacactgaacctcattgggcactctgtaattggatgtcctgggtcctcccaattcttagtcctttaatacctatttttctccttttattcagaccttgtatcttctgtttagtttctcaattcatccaaaaccgtatccggggcatcaccaatcattctatacgacaaatgtttcttctaacaaccccacaatatcaccccttaccacaaaatcttccttcagcttaatctctcccactctaggttcccacggcgcccctaatcctgctcgaagcagccctgagaaacaccgcccattatctctccatgccaccccctcaaaaaaaatttctttctgctgccccaacacttcaatactattttatgttatttttcttattaatataagaaggcaggaatgtcaggcctctgagcccaagctaagccatcgcatcccctgtgacctgcatgtgtatgcccagatggcgtgaagtaactgaagaatcacaaaagaagtgaaaatggcctgttcctgccttaactgacattccaccacaaaagaaatgaaaatggctggtccttgccttaagtgatgacattaccttgtgaaattccttttcctggctcatcctggctcaaaaaagctcccccactgagtaccttgtgaccccccactcctgcccaccagagaacaaccccactttgactgtaattttcctttacctacccaaatcttataaaatggccccaccccatctcccttcactgactctcttttcggactcagcctgcatgcagccaggtgattaaaaagctttattgctcacacaaagcctatttggtggtctcttcatgcgaacgcgagtgaaa

SEQ ID NO: 584 - DNA, 158 bp, Homo sapiens
ttcttttttgggaaaataagaccaagggagctaacgaaagccaagccccaaacaccccaatcttagcaggcataactatagctaccagttatctgggtgtgtcagcagccttaggattttttttagctgtccttaccatccccgctttgtttcatttt

SEQ ID NO: 585 - DNA, 3168 bp, Homo sapiens
tcccacattattcctgataccacacctgacccccatgactgtatctttctgatctacctgacattcactccatttacccatatttcattctttcctgttcctcaccctgatcacacttggtttattgatggcagttccatcaggcctaattgtcactcattagcaaaggcaggctatgctatagtatcttccacatctatccttgatgttaccactctgtccacctccactacctgtcagcaagccaaactcattgccttaactcaggctctcactcttgcaaagggactacacatcaatatttatactgactctaaatatgccttccatatcctgcaccaccatgctgttatgtaggctaaaagaggtttcctcgctatgcaagtgtcctccatcattaatgcctctttaataaaaactcttctcaaggccactttacttccaaaggaagctggagtcattcactccaagggccatcaaaaggcatcagatcccatcactcaggacagtgcttatgctgataaggtagctaaagaagcagctagtgtcccaacttctgtccctcatggccagtttttctccttctcatctgtcactcccacctactctcccactgaaacttccacctatcaatctctttccacacaaggcaaatggttcttggaacaaggaaaatatctccttccagcctcacaggcctattctattctgttgtcattttgtaaccccttccatgtaagttgcaagctgctatcctgcctcttaaaacctctcatttcctttcctttgtaaaaatctatcctaaaaaaatcacttctctgtcccatctgctatactactactactcaggaattcctcaggccccctcccttccctacacatcaagctcgagaatttgccctgcccaggactggcaaattgactttactcacatgccccgagtcaggaaactaaaatacctcttggtctgggtagacactttcattggatgggtagaggactttcccacagggtctgagaaggccaccatagtcatttcttcccttctttcagacataattcctaggcttggccttcccacctctatacagtctgataatggaccggcctttattagtcaaatcacccaagcagtttctcaggctcttggtattcagtggaaccttcataccccttaccattctcaatcttcaggagaggtagaatggactaatggtcttttaaagacacatctcaccaagctcagcctccaacttaaaaaagattggacagtacttttacctcttgcctttctcagaattagagcctgtccttgagatgctagagggtacagtccatttaaacttttatatagacacactttcttgcttggccccaacctcgtctcagacaccagtcctctaggaatctatctgctggtcctccagcaggcaagacaggaaatttgccaagctgctaatcttttcttgcctactccatattcccagccatataaagacaccctagatggacgatcagttcttgttaagaatctgacccctcaaactctataaccttgatagaccggaccctacttagtcatctataataccccaactgccatccgcctgtaagaccctccctattaggctcaccattccagaataaagctgtgtccattggacagccagcctaatctctcctcttcctcctagaagttgcaagtactcaaccctacttcccttaaactcactcacatttctgaagaacagtagtaacccttatgagcctaaaacatcctttcattctattaagtttattaccctacttattgcaacaaggctttatgcagtcacccccactacttggactgcaaccccaaaacttgtcatccctactatcttctgtctagtcatactcctattcaccattctcaactactcgtaaatgccctgcccttgtttacactgccagtttacacttttcctccaaaccatcataactcatatctcctggttttacctcaaaccaccttccttaagtctctcttgaagtggatagaagatcttcagtgacaaggtacactccaatactttcaccctaataaagtcctattctttacctttatattcactcttattctcattcctgttcttatgcgaccctctacctctccccagctatctccaccacactatcaatctcattcactctctcctagctgtttctaatccttctttaaaaaatgattgctggctttgcatttctctttcctccaaaatcactgaggccttgacttactgctcaaaaaaaggggactgtgtgtatttttaaatgaaaagtgttgtttttacctaaatcaatctggcttggtatatgacaacataaaaaaactcaaggatagagcccaaaaactcatcaaccaagaaaataatcacgctgaacccccttaggcactctgattggatgtcctgagtcctcccaattcttagtcctttaatacctgtttttctccttctgttattgggaccttgtgtcttctgtttagtttctcaattcatacaaaactgtatccaggccatcaccaatcattctatgtgacaaatattccttctaacaaatccacaatatcaccccttaccacaaaatcttccttcagctttatctctcccactctaggttcccacgccacccctaatcccactcaaagcaaccctaagaaacatcacccagtaactctccataccaccccccaaaaaatttttcaccgccccaacacttcaacactattttgttttatttttcttattaatataaaaagacaggaatgtcaggcctctgagcccaagcctgcatgtatacatccagatggcctgaagcaactgaagaatcacaaaataagtgaaaatggctggttcctgccttagctgatgacatttgtgaaattcattctcctggctcagaagctcccccactgagcaccttgtgtcctccacccctgcccgccagagaacaaccccctttgacagtaattttccactacctacccaaatcctataaaactgccccacccctatctccctttgctgactctcttttcagactcagcctgcccgcacccaggttattaaaaagctttattgctcacacaaagcctgtttggtggtctcttcacatggacgtgtgtga

SEQ ID NO: 586 - DNA, 4983 bp, Homo sapiens
cttctcccttagcctgtattcttaagaacttcagacctcttcagctctcacctgacctaaaatctaagcgtctttttttcttctgcaatgctgcttgaccccaatacaaacccgacagtagttccaaatagccggaaaattgcactttcaatttttccatcctacaagatctaaataattcttgtcgtaaaataggcaaacgggctgaggtgcctgacatccaggcattcttttacacataggtccctccctcatctctgttcccaatgcaactcatcccaaatcttccttctttccctcctgcctgtcctctcagtcccaaccccaagcgtcgctgagtctttctaatcttccttttctacagacccatctgacctctcccctcctcgccaggccaagctaggtcccgattcttcctcagcctccgctcctccaccctataatccttttatcacctcccctactcacaccaggtccgacttacagtttcattccgtgagtagccctcccccacctgcccagcaatttcctcttaaaaaggtggctggagctaaaggcatagtcaaggttaatgctcctttttctttatcccaaatcagatagcatttaggctctttttcatcaaatataaaaatccagcccagttcatggctcgtttggcagcaaccctgagatgctttacagccctagaccctaaaaggtcaaaaggccgtcttattctcaatatacattatattacccaatctgctcccgacattaaataaaactccaaaaatgaaattccggccctcaaaccccacaacaagacttaattaacctcaccttcaaggtgtacaataatagagtagaggcagccaagtaacaatgtatttctgagttgcaattccttgcctccactgtaagacaaaccccagccacatctccagcacacaagaacttccaaacacccgaactgcagcggccaggcattcctccagaaccgcctcccccaggagcttgctacaagtgacagaaatctggccaccagggcaaggaatgcctgcagcccaggattcctcctaagccgtgtcccatctgtgcaggaccccactgaaaactggactgttcaactcacctggcagccactcccagagcccctggaactctggcccaaggctctctgactgactccttcccagatcttctcagcttagcggctgaagactgatgctgcccgatcgccttggaagccccatagaccatcacggacgccaagctttaagtaactctcacagtggagggtaagtccgtccccttcttaatcaatatggaggctactcactccacattaccttcttttcaagggcctgtttcccttgcctccataactgttgtgggttttgacagccaggcttctaaacctcttaaaactccccaactctggtgccaactaagacagtactcttttaagcactcctttttagttatccccacctgcccagttctcttattaggctgagacactttaactaaattatctgcttccctgactattcctaggctacagccgcacctcattgccatcttttcccccagttcaaagcctccttcacatcctccccttgtatctccccaccttaacccacaagtataagacacctctactccctccttagcgaccgatcatgcaccccttaccatcctattaaaacctaatcactcttaccccactcaatgccaatatcccatcctacagcaggctttaaaaggattaaagcctgttatcactcacctgctacagcataggcttctaaaacctataaactctccttacaattcccgcattttacctgtcctaaaactagacaagacttagaggttagttcaggatctgcgccttatcaaccaaattgttttgcctatccaccccgtggtgccaaacccgtatactctcctatcctcaatacctccctccacaacccattattctgttctagatctcaaacatgctttctttactattcctttgcaccctttatcccagcctctcttcgctttcacttggactgaccctgacacctattaagctcagcaaattacctaggctgtgctgccgcaaggcttcacagacagcccccattatttccatcaagcacaaatttcttcctcatctgttacctatctcggcataattctcataaaaacaatgtgctctccctgctgatcgtgtccggctaatctcccaaaccccaatcccttctacaaaacaacaactcctttccttcctaggcatggttagtgcggtcagaattcttacccaagagccaggaccacaccctgtagcctttttatccaaacaacttgaccttactgttttagcctagccctcatgtctgtgtgcatcagctgccgctgctttaatacttttaaaggccctaaaaatcataaactatgctcaactcactctctacatttctcataacttccaaaatctattttcttcctcccacctgatgcacatactttctgctccccagctccttcagctatactcattctttgttgagtctcccacaattaccattgttcctggcacggacttcaatctggccttccacattattctggataccacacctgaccctcatgactgtatctctctgatccacctgacattcatcccatttccccatatttccttctttcctgttcctcaccctgatcacatttagtttattgatggcagctccgccaggcctaatcaccactcaccagcaaaggcaggctatgctatagtatcttccccatctatcattaaggctaccgctctgcccccctccactacctctcagcaagccaaactagttgccttaactcaagccctcactcttgcaaaaggactacacgtcaatatttatagtgactctaaatatgcctgtcatattctgcaccaccatgctgttatataggctgaaagaggtttcctcactacgcaaaggttctccgtcattaatgcctctttaataaaaactctgctcaaggccactttacttccaaaggaagctggagtcattcactgcaaaggccatcaaaaggcatcagatcccattgctctaggcaacgcttatgctgataaggtggctagacaagcagctagcttcccaacttctgtccctcacagccaatttttctccttcgcattggtcactcccacctactcccccgctgaaacttccacctaccaatctcttcccacacaaggcaaatagttctaagaccaaggaaaatatctccttccagcctcacaggcccattctattctgtcgtcatttcataacctcttccatgtaggttacaagctgctagcccgtctcttagaacctctcatttcctttccatcatggaaatctatcctcaaggagatcacgtctcagttgttccatctgctattctactaaccctcagggattgttcaggccccctccctttcctacacatcaagctcgaggatttgtccctgcccaggactggcaaattgactttactcatatgccctgagtcagagaactaaaatatctcttagtctaagtagacactttcactggatgggtagaggcctttcccacaaggtctgagaagtccactgcggtcatttcttcccttctgtcagacataattcctcggtttggccttcccacctctatatagtctgataatggaccagcctttattagccaaatcagccaagcattttttcaggctcttagtattcagtgaaacctttatatcccttacagtcctcagtcttcaggaaaggtagaacagactaatggtcttttaaaaacacacctcatcaagctcagccaccaatttaaagaggactggacaatacttttaccactttcccttctcagaattcaggcctgtcctcagaatgcgacaaggtacagcccatttgagctcctgtatagacgctcctttttattaggccccggtctcattccagacaccagaccaacttggactgtgccccaaaaaactcgtcatccctactatcttctgtctagtcatactcctgctcaccattctcaactactcatacatgccctgctcttgtttacactgccagtttacactgtttctccaagccatcacagctgatatctcctggagctatccccaaaccgccactcttaactcttaaataaataatctttgctgggcaaggctatgctgaacctccttaggcactctctaattagatgtcctaggtcctcccaattattagtcctttaatacctgtttttctccttctcttattccatttagttttcaattcatacaaaactgtatccaggccatcaccaataattctaaatgacaaatgtttcttctaacaaccccacaatatcaccccttgccacaaaaccttcagcttaatctctcccactccaggttcccacactgcccctaatcccgctcgaagcagccctgagaaacatcacccattatctctccataccaccccccaaaattttcactgccccaacactttaccactatttcattttatttttcttattaatataagaagacaggaatgtcaggcctctgagcccaagctaagccatcatatcccctgtgacctgcatgtacacatccagatggctggttcctgccttaactgatgacattccaccacaaaagaagtgaaaatggcctgttcctgccttaactgatgacattatcttgtgaaattccttctcctggctcatcctggctcaaaagctcccctactgagcaccttgtgacccccactcctgcccaccacagaacaaccatcctttttcctttacctacccaaatcctataaaatgccccacctctatctcccttcactgactctcttttcagactcagcccgcctgcacccaggtgaaataaacagctttattgctcacacaaagcctgtttggtggtctcttcacacggacgcacatgaaa

SEQ ID NO: 587 - DNA, 451 bp, Homo sapiens
gtcaggcctctgaggccaagccaagtcatcgcatcccctgtgacttgcgcgtatatgcccagatggcctgaagtaactgaagaatcacaaaagaagtgaatatgccctgccccgccttaactgatgacattccaccacaaaagaagtgtaaatggccggtccttgccttaagtgatgacattaccttgtgaaagtccttttcatggctcaccctggctcaaaaacacccccactgagcaccttgcgacccccactcctgcccgccagagaacaaaccccctttgactgtaattttcctttacctgcccaaatcctataaaacggccccacccttatctcccttcactgactctcttttcagactcagcctgcctgcacccaggtgaaataaacagccatgttgctcacacaaagcctgtttggtggtctcttcacacggacacgcatgaaa

SEQ ID NO: 588 - DNA, 497 bp, Homo sapiens
gttatgaggtcaccacttctcctgttgtccttctcagtttctccccaacctccccttttccctagtttataagacaggagaaaagggagaaagcaaaaagttggaaagaaacagaagtaagataaatagctagacgactttggcgccaccacctgaccctggtggctaaaataataataatattattaacccctgaccaaaactactggtgttatctgtaagttccagacattgaatgagaaagcactgtaaaactttttgttctgttagctgatgtatgtagcccccagtcacgtttctcatgcttacttgatctattatgactttttcaggtagaccccttagagttgtaagcccttaaaagggctaggaatttctttttcagggagctcggctcttaagacacgagtctgccgatgctcccagctgaataaaaaaacctcttccttctttaatctggtgtctgaggagttttgtctgctactcctcctgctaca

SEQ ID NO: 589 - DNA, 7898 bp, Homo sapiens
gagagacaggactagctggatttcctaggccgactaagaatccctaagcctagctgggaaggtgactgcatccacctttaaacacggggcttgcaacttagctcacattcgaccaatcaggtaattaaaaaaagctcactaaagtgctaattaggcaaaaacaggaggtaaagaaatagctaatcatctatcgcctgagagcacagcgggaggcagaatgatcgggacataaacccaggcattcgagccagcaagttaccctctttgggtcccctccctttgtatgggagctctgttttcactctattaaatcttgcaactgcactctcttttggtccgtgtttgttacggctcgagctgagctttcactcgccgcccaccactgctgtttgctgccgtcggagacccgccgttgacttccatccctccagatccagcagggtgtccgctgtgctcctgatccagtgaggcacccattgccgctccggatcaggctaaaggcttgccattgttcctgcacagctaagtgcccgggttcatcctaatcgagctgaacactagtcactgggttccactgttctcttccatgacccacggcttctaatagagctataacactcaccgcatgatccaagattccattccttggaatccatgaggctaagaaccccaggtcagagaacacaaggcttgccaccgtcttggaagcagcctgccaccatgttgggagctctggaagcaaggaccccccagtaacattttggcgaccacgaagggacctccaaaatggtgagtaatatcggaccactttcacttgctattctttcctatccttccttagaattggaggaaaataccgagcacctgtcggccagttaaaaacgattagtgtggccaccggacttaagactcaggtgtgaggctatctggggttgggagcctacaaccagcttccactttcaattttcttggggaagctgagggctgactagaggcagaaacctgttgtcccgaactcccagcattagcccattgagatcatggcacagccagaagtctctacttaacagtcgcccatgtgtgcacccctacctttccttttgacccatacctcctgggtcctgaccaggactttcttgaaagtgtagccccaaaattctccttaccgccgaatctacttcctctgatccctgcctcctaggcactaatggttcagacttcatttcctctagcaagttgtatctccaaagggatctaaggaagctctaggctgcatccttaggcatctagacaataaacccagggagtcttatccctggtgtccctcccgatttaggtatacagctctcaacatgggcagttacgtgggacccgttctctaccacccttgccagggcctcaagtttgtaaatggctaagagagagacagaggggagagagagagagagagatagaggagagagagagggaagagggagagagagagggaagagagagagagggaagagagagagagagacagaggagagagagatggaggagagagagacggaggagagacggaggagagagatagaggagagagagaaagagacagaggagagagagagaaaaagagggagtcaaagagaaagagaaagatagtaatagtaaaaatcagtgtgccctattcctttaaaagccagggtaaatttaaaacctataattgataattgaaggtcttctccgtgaccccataacactccaatactaccttgttgtcagtgtaaacaagggcgtagcctgaaaacactgagaccactgacaacccgtagctttcctatcaaaaacccttcattaaccctgtaacccgccgatgcattcaatctgtagcggcaactgctttgctaacagaagaaagtagaaaagaaacttttagaggaaacctcattgtgaggaaacctcattgtgagcacacctcaccagttcagaattatcctgagtcaaaaaagaaaaaggtagcatactaactcaaaaatcttaaagtatggggctatcctgttaaaaaaaggtaatttaacaccaaccactgataattcccttaacccagcagatttcctaacaggggatttaaatcttaattaccatataaaagtccaaaaagacctaggaggaattcccttcaggacaggatgatagatgattcctcccaggtgattgaggaaaaaaccacaatgagtattcagtaattgatagggagactcttgtggaagcagagttagaaaaattgcctaataattggtctcctcaaacgtgtgagctgtttgcactcagccaagccttaaagtacttacacaatcaaaaaagactactcaatcctgactcaaaaggttacctacaccctctctgaaatgaatttgcataagaactgtttatgggagttcatcttgatggggcagctgggttgttatgaaatactcaggaacccagcccagctctaggactcacccctgagcacaaaagcaatgttgggcaccctggtaaaggaccactagaattcagcagcccagacccctttctttgtggtcaagaaaggcgggaaaaggagtgcaggactgctgcatcagtgagcttaactaatctgataagcagaagtccatggttgtgcaccctggaaaggaataagcattagtaccatagaggacactctaggactaatgctctacgggaaatgactaggggtgctggcatccctatgttctttttccagaagggaaatgttccccccaaggcaaaaacgcccctaagatgtattctggagaattgagacaagtttgaccctcagacgctaagaaagaaatgacttatattcttctgcagaaccacctggccatgatatcctcttcaagagggagaaacctggcctcctgggggaagtataaagtataacaccatcttacagctagacctcttttgtagaaaaaaaggcaaatggagtggaatgccatacatacaaactttcttttcattaaaagacaattcgcaattatgtaaaaagtgtgatttatgccttacaggaagccctcagagtctacctccctaccccagcatgcccccgactccttccccaactaataaggacccccctttaacccaaactgtccaaaaggagatagacaaaggggtaaacaaggaaccaaagagtgccaatattccccgattatgccccctccaagcagtgggaggaggataattcggcccagccagagtgcatgtacctttttctctctcagattaaagcaaattaaaatagaccttggtaaattctcagataaccctgatggctatattgatgttttacaagggttaggataatcctttgatctgacatggagagatataatgttactgctaaatcagacactaaccccaaatgagagaagtgccgccataactgcagcctgagagtttggcgatctctggtatctcactcaggtcaatgataggatgacaacagaggaaagagaacgattccccacaggccagcaggcagttcccagtgtagacccccactgggacacagaatcagaacatggagattggtgtcgcagatatttggtaacttgcgtgccagaaggacttaaggaaaactaggaagaaacctatgaattattcaatgatgtccactataacagggaaaggaagaaaatcctactgcctttctggagagactaagggaggcattgaggaagcatacctccctgtcacctgactctattgaaggccaactaatcttaaaagataagtttatcactcagtcagctgcagacattagaaaaaaaaacttcaaaagtctgccttaggcctggagcaaaacttagaaaccctattgaacttggcaacctcggttttttataatagagatcaggaggagcaagtggaacgggacaaacaggatacaaaaaaggccaccgctttagtcatggccctcaggcaagcggactttggagcctctggaaaagggaaaagctgggaaaattgaatgcctaatagggcttgcttccagtgtggtctacaaggacactttaaaaaagattgtccaagtagaaataagccaccccctcgtccatgccccttatgccaagggaatcactggaaggcccactgacccaggggatgaaggtcctctgagtcagaagccactaaccagataatccagcagcaggactgagggtgcccagggcaagtgccagcccatgccagcaccctcacagagcctccagtatgcttggccattgagggccaggaggttaactgtctcctggacactggcgtagccttctcagtcttactctcctgtcctggacaactgtcctccagatctgtcattatccgaggggtcctaggacagccagtcactagatacttctcccagccactaagttgtgactggggaactttactcttttcacatgcttttctaattatgcctgaaagccccactcccttgttagggagagacatcctagccaaagcaggggccgttatacacctgaacataggagaaggaacacctgtttgttgtcccctgcttgaggaaggaattaatcctgaagtctgggcaacagaaggacaatatggatgagcaaagaatgcccatcctgttcaagttaaactaaaggattccacctcctttccctaccaaaagcagtaccccttagacccgaggcccaacaaggactccaaaatattgttaaggacctaaaagcccaaggcctagtaaaaccatgcaatagaccctgcaatactccaattttaggagtatagaaacccaacggacagtggaggttagtgcaagatctcaggattatcaatgaggctgttgttcctctatacccagctgtacctaacccttacactctgctttcccaaataccagagaaagcagagtggtttatactcctggaccttaaggatgcccttttcttcatccctgtacatcctgactctcaattcttgtttgcctttgaagatccttcaaactcaacatctcaactcacctggactgttttacccctagcgttcaggaatggcccccatctatttggccaggcatcaacccaagacttgagccagctctcatacctggacactcttgtcctttggcatgtggatgatttacttttagctgcctgttcagaaaccttgtgccatcaagccacccaagcactcttaaatttcctcactacctgtggttacaaggtttccaaaccaaaggctcaactctgctcacagcaggttaaatacttagggctaaaattacccaaaggcaccagggcccccagtgaggaatgtatccagcctatactggcttatcctcatcccaaaaccctaaagcaactaagagcgttccttggcataacaggtttctgccgaatatggattcccaggtacggcaaaatagccagaccattatatacactaattaaggagactcggaaagccaatacccatttagtaagatggacacctgaagcagaagcagctttccagaccctaaagaaggccctaacctaagccccagtgttaagcttgccaacggggcatgacttttctttatgtcacagaaaaaaaacaggaatagctctaggagtccttacacaggtccgagggatgagcttgtaacccgtggcatacctgagtaaggaaattgatgttgttgcaaagggttggcctcattgtttatgggtagtggcggcagtagcagtcttagtatctgaagcagttaaaatgatacagggaagagatcttactgtgtggacgtctcatgatgtgaacagcatactcactgctaaaggagacttgtggctgtcagataaccatttacttaaatatcaggttctattacttgaagggccagtgctgcaactgcgcacttgtgcaactcttaacccagccacatttcttccagacaatgaagaaaagatagaacataactgtcaacaagtaattgctcaaacctacgccactcgaggggaccttttagaggttcccttgactgatcccgacctcaacttgtatactgatggaagttcctttgtacaaaaaggacttcaaaaagcgggatatgcagtggtcagtgataatggaatacttgaaagtaatcccttcactccaggaactagcactcagctggcagaactggtagccctcacttgggcactagaattcggagaaggaaaaagggtaaatataaatacaggctctaagtatgcttacctagtcctccatgcccatgcatcaatatggagagaaagggaattcctaacttccgagggaacacctatcaaacatcaggaagccattaggagattattattggttgtacagaaacctgaagaggtggcagtcttacactgctggggtcatccgaaaggaaaggaaagggaaatagaagggaactgccaagcggatattgaagccaaaagagcctcaaggcaggaccctccattagaaatgcttatagaaagacacctagtatggggtaatcccctctgggaaaccaacccccagtactcagcagaagaaatagaatggggaacctcatgagaacatagtttcctcccctcaagatggctagccactgaagaagaaaaaatacttctgcctgcagctaaccaatggaaattacttaaaacccttcaccaaacctttcacttaggcattgatagcacccatcagatggccaaatcattatttactggaccaggcctttttgaaactatcaagcagatagtcagggcctgtgaagtgtgccaaagaaataatcccgtgcactgcaggccatacatttcaatccctgtatctttaccctccttgttaagtttgtctcttccagaatcaaagctgtaaaactacaaatagttcttcaaatggagccgcagatgcagtccatgactaaaatctactgtggacccctggactggcctgctagcccatgctccaatgttaatgacattgaaggcacccctcccaaggaaatctcaactgcacaacccctactatgccccgattcagcaggaggcagttaaagtggtcgttggccaaactccccaacagccgttggtttttcctgttgagaggggatactgagagacaggactagctggatttcctaggctgactaagaatccctaagactagctgggaaggtgaccacatccaccttgaaacacggggcttgcaacttagctcacatccaaccaatcaggtaataagaaaagctcactaaaatgctaattaggcaaaaacaggaggtaaagaaatagccaatcatctatcacctgagagcacagcgggagggacaatgatcgggatataaacccaggcattcgagccagcaacagctaccctctttggtcccctccctttgtatgggagctctgttttcactctattaaatcttgcaactgcactctcttttggtccatgtttattatggctcgagctcatctttcgctcgccgcccaccactgctgtttgctgccattgcagacccgccattgacttccatccctccagatccagcagggtgtccgctgtgctcctgatccagtgaggcacccattgctgctccggattgggctaaaggcttgccattgttcctgcacagctatgtgcccgggttcatcctaatcgagctgaacactagtcactgggttccatggttctcttccgtgacccacagcttctaatagagctataacactcactgcatggcccaagattccattccttggaatccgtgaggccaataaccccaggtcagagaacacaaggcttgccaccatcttggatgcagcctgccaccttcttggtagctctgggagcaaggaacccctggtaacacttatagcagc

SEQ ID NO: 590 - DNA, 5602 bp, Homo sapiens
gtcgggcctctgagcccaagctaagccatcatatcccctgtgacctgcacatacacatccagatggcctgttcctgccttaactgatgacattgtcttatgaaattccttttcctggctcatcctggctcaaaaagctcccctactgagcaccctgtgacccccactcctgcccaccagagaacacgcccactttttcctttacctacccaaatcctataaaacggccccacccctatctcccttcgctgacattctttttggactcagcccgcctgcacccaggtgaaataaacagctttattgctcacacaaagcctgttcggtggtctgttcacacagacgcacatgaaatttggtgccatgactcggatcgggggacctcccttgggagatcaatcccctgtcctcctgctctttgctccatgagaaaggtccacttacgacctcaggtcctcagactgaccagcccaagaaacatctcaccaatttcaaatccagtaagcggcctctttttactctcttctccaacctccctcactatccctcaacctctttctcctttcaatcttggcgccacacttcaatctctcccttctcttaatttcaattcctttcattttctggtagagacaaaggagacacgttttatccgtggacccaaaactctggcgctggtcacagactgggaaggcagccttcccttggtgtttaatcatcgcagggacgcctgtctgattattcacccacgtttcagaggtgtcagaccacgcagggacgcctgccttggtccttcatccttagcaagtcctgcttttctgggggaggggcaagtaccccaaccccttctctccatgtctctaccccttctctgcttttctaggggaagggcaagaacccctcaaccccttctccttcaccctcagcggcaagtcctgcttttctggtggagggacaagtaccccaacctcatatctctgtgccccaatcccttatttccatgccccaacctcgttatttctgcgccgcaacccctttcctgcttttctggagggtaagaacccctgaaccacttccctccatgtctgtactctcccttttctttaaacttgcctccttcactataggcaaccttccaccctccattcctccttcttctcccttagcctgtgctctcaagaacttaaaacctctttaactcacacctgacctaaaaccgaaatgccttattttattctgcaatgccacttgaccccaatacaaactcgacagtggttccaaatagccagaaaacggccctttcaatttctccgtcctgcaagatcttaataattcttgtcgtaaaataggcaaacagtctgaggtgcctgacgtccaggcattcttttacacatcagtccctccctagtctctgtgcccaatgcaactcatcccaaatcttcccttctttccctcccgcctgtaccctcagtcccaacccaaagcatcgctgagtctttctaatcttccttttctacagacccatctgacctcccccctcctccccaggctgctccttaccaggccaagctaagtcccaattcttcctcagcctctgcacctcaagcctataatctttttatcacctcccctcctcacacccagtccggcttacggtttcgttctgtgaatagccctccccacctgcccagcaatttcctcttaaaaaggtggctgaagctaaaggcatagtcaaggttaatgctcctttttctttatccaacctctcgcaaatcagtgagcatttaggctctttcaacaaatatgaaaaacccagcccagttcatggctcattcagcagcaaccctgaaacgctttacagccctagaccctaaaaggtcaaaaggccatcttattctcaatatacgttttattacccaatccgctcctgacattaaataaaactccaaaaattaaattccggccctcaaaccccacaacagcacttaattaacctcaccttcaaggtgtacaataatagagtagaggcagccaagtagcgacgtatctctgagttgcaattccttgcttccactgtgagacaaaccccagccacatctccagcacacaagaactccaaacgcctgaaccacagctgccaggagttcctccagaacctcctcccctaggagcttgctacaagtgttagaaatctggccactaggccaaggaatgcccacagcccaggattcctcctaagccttatcccatctgtgtgggaccccactgaaaatcagactgttcaactcacctggcagccactcccagagcccctggaactctggcccaaggctctctgactgactgctacccagatcttcttggcttagcagctgaagactgacactgcccgatcaccttggaagcctacaggaccattacagatgctctaggtaactctcacagtggaaagtaagtccgtccccttcttaatcaatacagaggctacccaccccacattaccttcttttcaaaggcctgtttcccttgcttccataactgttgtgggtattgatggtcaggcttctaaagctcttaaaactccccaactctggtgccaacttagacaatactcttttaagcactcctttttagttatccccacctgcccagctcccttattaggccaagacattttaactaaattatctgcttccctgactgttcctaaactacagccacacctcattgctgcccttttccctagttcaaagcctccttcgcatcctcctctcatatccccccaccttaacccacaagtataagatacctctattccctccttggcaaccgatcatgcaccccttacaatctcattaaaacctaatcacccttacccccctcaatgccaatatcccatcccacagcatgctttaaaaagattaaagcctgttatcactcgactgctacagcatggccttttacagcctataaactccccttacaattccccctttcacctgtcctaaaaccagccaaggcttacaggttagatcagaatctgcaccttatcaaccaaattgttttgcctatccaccccatggtgccaaacccatatactctcctatcctcagtacctccctctacaacccattattctgttctggatctcaaacatgctttctttactattcctttgcacccttcatcccagcctctcttcgttttcacttagactgaccctgacacccattaggctcagcaaattacccgggctgtactgccgcaaggcttcacagacagcccccattacttcagtcaagcccaaatttcatcctcatctgttacctatcttggcataattctcataaaaacactcgtgctctccctgctgattgtgtcccattaatctcccaaacctcaatcccttacaaaacaacaactcctttccttcctaggcatggttagtgtggtcagaattcttacacaagagccaggaccacaccctgtagcctttctgtccaaacaacttgaccttactgttttagcctagccttcatgtctgcatgcagctgctgccactgctttaatacttttagaggccttaaaaatcacaaactatgctcaactcacgctctacatttctcataacttccaaaatctattttcttcctcacacctgacgtatatactttctgctccctggctccttcagctgtactcactctttgttaagtcccacaattaccactgttcctggcccggacttcaatccggcttcccacattattcctgataccacacctgacccccatgactgtatctctctgatccacctgacattcacccaatttccccgtatttccttctttcctgttcctcacactgatcacgcttgatttattgatggcagttccaccaggcctaatggccacacaccagcaaaggcaggctatgctatagtacaagccactaggccacctcttagaacctctcattttctttccattgtagaaatctatcctcaaggaaatcacttctcagtgttccatctgctattctactactcctcaaggattattcaggcccccttccttccctacacatcaagctggaggatttgcccccacccaggactggcaaattagctttactcaacatgccctgagtcagataactaaaatacctcttggtcaaggtagacactttcactggataggtagaggcctttcctacagggtctgagaaggccaccgcagtcatttcttcccttctgtcagacataattcctcagtttagccttcccaccactatacagtctgataacagaccagcctttattagtcaaatcagccaagcagtttttcaggctcttagtattcagtgaaacctttatatcccttacggtcctccatcttcagaaaaagtagaatagactaaaggtcttttaaaaacacacctcaccaagctcagccaccaacttgaaaaggactggacaatacttttaccactttcccttctcagaactcagacctgtcctcaggttgctacagggtacagcccatttgagttcttgtatagacgctcctttttattaggccccagtctcattccagacaccagaccaacttggactgtgccccgaaaaatttgccatccctactatcttctctctagtcatactcctattcactgttctcaactattcatatatgccctgctcttgtttacactgccagtttatactgtttctccaagctatcacagatgatatctcctggtgctatccccaaaccgccactcttaactcttatagtaaataaataatctttgctggcaaggctatgctgaacctccttaggcactctctaattagatgtcctaggtcctcccaattcttagtcctttaatacctgtttttctccttctcttattccgtttagtttttcaattcatacaaaactgtatccaggccatcaccaataattctaaatgacaattgtttcttctaacaaccccacaatatcacccttaccacgaaatcttccttcagcttaatctctcccactttaggttcccacgctgcccctaatcccgctggaagcagccctgagaaacatcgcctattatctctccataccaccccccaaaattttcgccgtcccaacactttaccactatttcattttatttttctcattaatataagaagacaggaatgtcaggcctctgagcccaagctaagccattgtatcccctgtgacctgcacgtacacatccagatggccggttcctgccttaactgatgacattccaccacaaaagaagtgaaaatggcctgttcctgccttaactgatgacattgtcttgtgaaattccttttcctggctcatcctggctcaaaaagctcccctactgagcaccttgtggcccccactcctgcccaccagagaacaacccccctttttcctttacctacccatatcctataaaatggcctcacccctatctcctttcactgactctcttttcggactcagcccgcctgcacccaggtgaaataaacagctttattgctcacagaaagcctgtttggtggtctcttcacacggacgtgcatgaaa

SEQ ID NO: 591 - DNA, 5709 bp, Homo sapiens
gtcaggcctctgagcccaagccaagccatcgcatcccctgtgacttgtgcccagatggcctgaagtaactgaagaatcacaaaagaagtgaaagaccctgcccgaccttaactgatgacattccaccattgtgatttgttcctgccccaccttaactgagtgattaacgctgtgaatttccttctcctggctcagaagctcccccactgagcagcttgtgcccccactcccccgcccctgcccaccagagaacaaaccccctttgactgtaattttccattaccttcccaaatcctataaaacggccccacccctatctcccttcattgactctcttttcggactcagcccacctgcacccaggtgaaataaacagccatgttgctcacacaaagcctgtttggtggtctcttcacacagatgtgcatgaaatttggtgtggtgactcggatcgggggacctgcctcaggaaatcaatcccctgtcctcctgctctttgctccgtgagaaagatccacctacgacctcaggtcctcagaccgactagcccaagaaacatctcaccaatttcaaatctggtaagcggcctctttttactctcttctccaacttccctcactatccctcaacctctttctcctttcaatcttggtgccacacttcaatctctcccttctgttaatttcaattcctttcattttctggtagagacaaaggagacacgttttatccgtggacccaaaactccggagccggtcacggactgggaaggcagccttcccttagtgtttaatcattgcagggacacctctctgattgttcaccaacgtttcaaaggtgtcagaccatgcagggacgcctgccttagtccttcacccttagcggcaagtcccgcttttctgggggaagggcaagtaccccaaccccttctctccatgtctctaccccttctctgattttctggggcaggggcaagaacccctcaaccccttctccttcacccttagcagcaagtcccgcttttctgggggaggggcaagtacccgtcaaccccttctccttcacccttagcggtaagtcccacttttctaaggggcaagaacgcccaatcccttctttccacacgccgacctcttatctctgtgccccaatcccttatttctgcaccctgacctcttatctctgtgtcccaatcccttatttccgtgccccaaccctttctctgcttttctggagagcaagaaccccccaccccttctctgtgtctctactcttttctctgggcttgcctccttcactatgggcaaccttccaccttccattcctccttcttctcccttagcctgtattcttaagaacttaaaacctcttcaactctcacctgacctaaaatctaagcatcttattttcttccgcaatgccacttgaccccagtacaaacttgacagtagttacaaatagccagaaaatggcgctttcaatttttccatcctacaaggtctaaataattcttgtcgtaaaatgggcaaatggtctgaggtgccttatgtccaggcattctttaacacatcagtcccttcctagtctctgtgcccagtgcaactcgtcccaaatcttccttctttccctcccgcctgtcccctcagtgccaaccccaagcgtcgctgagtctttctaatcttccttttctacagacccatctgacctctcccctcctcgccaggccgaactaggtcctaattcttcctcagcctccgctcttccaccctataatctttttatcacctcccctcctcacacctgctccggcttacagtttcattcagtgactacccctcccccacctgcctagcaatttactcttaaaaaggtggctggagccaaaggcatagtcaaggttaatgcacctttttctttatcccaaatcagaagcatttaggctctttttcatcaaatataaaaaccgagcccagttcatggctcattcggcagcaaccctgagatgctttacagccctagaccctaaaaggtcaaaaggccgtcttattctcaatatacattttattacccaatctgctcctgacattaaataaaactccaaaaattggaatctggccctcaaaccccacaacaggacttaattaacctcactttcaaggtgtacaataacagaaaaaagttgcaattccttgcctccactgtgagacaaaccccagccacatctccagcacacaagaacttccaaacacctaaaccgcagtggccaggggttcctccaaaacctcctcccccaggagtttgctacaagtgccagaaatctgaccaccaggccaaggaatgcctggagcccaggattcttcctaagccgtgtcccatctgtgcgggaccccactgaaaatcggactgttcatctcacctggcagccactcccagagcccgtggaactctggcccaaggctctctgactgactccttcttggcttagcggctgaagactgacactgcccgatcgcctcagaaaccccgtagaccatcacggacgccgagctttagttaactctcacagtggagggtaagtccgtccccttcttaatcaatacggaggctacccactccacatcaccttcttttcaagggcctgtttcccttgcttccataactgttgtgggtattgacagccaggcttctaaacctcttaaaactccccaactctggtgccaacttagacaatactcttttaagcactcctttttagttatccccacctgcccagttcccttattaggctgagacactttaaattatctgcttccctgactattcctggactacagctacatctcattgccacccttcttcccaatccaaatcctcctttgcgtcctcctcttgtattcccccaccttaacccacaagtataagatacctctactccctccttggtgaccgatcatgcaccccttaccatctcattaaaacctaatcattcttaccccctcaatgtcaagatcccatcccgcagcacgctttaaaaggattaaagcctgttatcactcgcctgctatagcatgaccttttaaagcctataaactctccttaccattcccccattttacctgtcctaaaaccagataaaccttacaagttagttcaggatctgcaccttatcaaccaaattgttttgcctatccaccccgtggtgccaaacccatacactctcctatcctcaatacctccctctactacccattattctgttctggatctcaaacatgcttactttactattcctttgcacccttcatcccagcctctctttgctttcacttagactgaccctgacacccattaggctcagcaattacctgggctgtactgccgcaaggcttcacagacagaccccatttcagtcaagcccaaatttcatcctcatctgttacctatctcggcataattctcgtaaaaacacacttgctctccctgctgatcttgtccgattaatctcccaaacctcaatcccttacaaaacaacaactcctttccttcctaggcatggttagtgcggtcagaattcttacacaagagccaggaccacaccctgtagcctttctgtccaaacaacttgaccttactgttttagcctagccctcatgtctgtgtgcagcagctgccactgctttcataattttagaggccctcaaaatcacagactatgctcaactcactctctacagttctcataacttccaaaatctattttcttcctcatacctgactcatatactttctgctccctggctccttcagctgtactcacattttgttaagtcccacaattaccattgttcctggcccagacttcaatccggcctcccacattattctagataccacacctgacccccatgactgtatctctctgatccacctgatgttcatcccatttccccacatttccttcttccctgtttctcaccctgatcacgcttgatttattgatggcggttccaccaggcctaatcgccacacaccagcaaaggcaggctatgctatagtagaagccactagcccgcctcttagaacctttcatttcctttccattgtagaaatctatcctcaaggaaataacttctcagtgttccatctgctattctactactcctcaatgattattcaggcccactaccttctctacacatcaatctggaggatttgcccccacccaggactggcaaattagctttactcaacatgccccgagtcacaaaaactaaaatacctcttattctaagtagacactttcactagttaggtagaggcctttcctacagggtctgagaaggccaccgcaatcctttcttcccttctgtcagacataattcctcagtttagccttcccacctctacacagtctgataacagaccagtctttattaatcaaatcagccaagcattttctcaggctcttagtattcagtgacagactaatggtctattaaaaacacacctcaccaagctcagccaccaacttaaaaaggactggacaatacttttaccactttcccttctcagaattcagcctgtccttggaatgctgcaggctacagcccatttaagctcctgtatagatgctcctttttattaggccccagtctcattccagacaccagaccaacttagactgtgcccccaaataacttgtcatccgtactatcttctatctagtcatactcctattcactgttctcaactactcatacatgccctgctcttgtttacactgccggtttacactgtttctccaagccatcacagctgatatctcctcctgctatccccaaactgccactcttaactcttgaagtaaataaataatctttgctggcaggactatgctgaacctccttaggcactctctaattagatgtcctaggtcctcccaattcttagtctttttatacctgtttttctccttctcttattccatttagtttttcaattcatacaaaaccgtatccaggccatcacccatcactctatatgacaaatgtttcttctaacaacccacaatatcaacccttaccacaagacctcccttcagcttaatctctcccactctaggttcccacgctgcccctaatcccgcttgaagcagccctgagaaacatcgcccattctctctccataccacccccaaaaaattttcgccgccccaacacttcaacactattttgttttatttttcttattaatataagaaggcaggaatgtcaggcctctgaacccaagccaagccatcacatcccctgtgacttgcacgtatgcacgtatgcacctagatggcctgaagttactgaagaatcacaaaagaagtgaaaaggccctgccccgccttaactgatgacattccaccattgtgatttgttcctgccccaccttaactgagtgattaaccctgtgaatttccttctcctggctcagaagctcccccactgatcagcttgtgacccccgcccctgcccaccagagaacaaaccccctttgactgtaattttccattaccttcccaaatcctataaaacggccccacccttatctcccttcgctgactcttttcggactcagcccatctgcacccaggtgaaataaacagccatgttgctcacacaaagcctgtttggtggtctcttcacacggatgcgcaagaaa

SEQ ID NO: 592 - DNA, 636 bp, Homo sapiens
caacagcaacaagcttttcacaagttaaaagaaaacctcatgtcagccccagccctggggctaccttacctgacaaaacactttacactctatgtgtcaaaaagagaaaaaaaatggcagttagagttttaacccagactatggggccctggccaaggccagcggcctatctctcaaaacaactagacggggtttccaaaggctagcccccatgtctaagggccctggcagcaacggcctgttagcacaagaagcaaataaactaacccttaggaaaacctgaatataaaggccccccatgctgtagtaactttaatgactaccaaaggacaccattggttaacaaatgctagattaaccaactaccaaagcttgctatgtgaaaatccccgcataaccattgaagtttgcaacaccctaaacctcgccaccttgctcctggtatcagagagcccagttgaacataactgtctagaggtgttggactcagtttattctagcaggcccaacctccgacaccattcttaaacatcagtagactgtgagcagtacgtggacgggagcagctttgccaacccctgcaaagtgactctgaagaagatgacaagccctgctccagtcacacccggaagctga

SEQ ID NO: 593 - DNA, 968 bp, Homo sapiens
gtggggaaaagaaagagagatcagactgttattgtgtctatgtagaaagaagtagacataagagactccattttgttctgtactaagaaaaattcttttgccttgagatgctgttaatctgtaaccctacccccaaccctgagctcccagaaacatgtgctctgtcaactcaaggtttaatggattaagggctatgcaggatgtgctttgttaaacaaatgcttgaaggcagcattcttgttaaaagtcatcaccactccctactctcttgtacccagggacacaaaacactgcagaaggccgcagggacctctgcctaggaaagctaggtattgtccaaggtttctccccatgtgatagtctgaaatatggcctcatgggaagggaaagacctgaccgccccccagcccaacacccataaagggtcggtgctgaggaggattagtaaaagaggaaggcctctttgcagttgagataagaggaaggcatctatctcctgctcgtccctggggcaatggaatgtgttgatgtaaaacctgattgtatattccatctactgagataggagaaaaccaccttagggttggaggtgagacatactggaagcaatactgctctttaaggcgttgagatgtttatgtatatgcacatcaaaagcgcagcacttttttctttaccttgtttatgatgcagagacatttgttcacatgttttcctgctgaccttctctccactattaccctattgtcctgccacatccccctctgcgagaaacgccagataatgatcaataaatactaagggaactcagagactggggccggcgctggtcctccgtatgctgagcaccggtcccctgggcccacttttctttctctatactttgtctctgtgtctctttcttttctcaagtctctcattccacctgacgagaaatgcccacaggtgtggaggggcagcccacccct

SEQ ID NO: 594 - DNA, 393 bp, Homo sapiens
gttggacctctgagcccaagctaagccatcatgtcccctgtgacctgcatgtgtacatccagatggcctgaagtaactgaagaatcacaaaagaagtgaaaatggccttttcctgccttaactgatgacattaccttgtgaaattccttctcctggctcatcctggctcaaaaactcccactgaacaccttgtgaccccccaacccctgccagccagagaacaaccccctttgtaattttccactacctacccacatcctataaaacagccccaccccatttcccttccctgactctcttttcggactcagcccacctgcacccaggtgattaaaaagctttttgctcacacaaagcctgtttggtggtctcttcacacagacgtgcatgaaa

SEQ ID NO: 595 - DNA, 104 bp, Homo sapiens
cacttggtctctcatggcacccactcggccctcttccaagtgtactttccttcctttcattactgctctaaagctttttaataaactttcaccctgatcaaaaa

SEQ ID NO: 596 - DNA, 5720 bp, Homo sapiens
caggcctctgagcttaagctaagccatcatatcccctgtgacctgcacgtacacatccagatggccggttcctgccttaactgatggcattccaccacaaaagaaatgaaaatggcctgtacctgccttaactgatgacattccaccacaaaagaaatgaaaatggcctgtccctgccttaactgatgacattatcttgtgaaattccttctcctggctcagcctggctcaaaagctcccctactgagcaccttgtgacccccacacctgcccgacagagaacaacccccctttgactgtaattttcctttacccaaatcttataaagcggccccacccctatctccctttgctgactctcttttcggactcagcccacccacacccaggtgattaaaaagctttattgctcacacaaagcctgtttggtggtctcttcacatggacgcacatgaaatttggtgccgtgactcgctctttgctctgtgaaaaagatccacctatgacctcgggtcctcagacccaccagcccaaggaacacctcaccaattttaaatcgggtaagcggcctcttcttactctcttctcgaacctctctcactatccctcaaccactttctcctttcaatcttggcaccacctttcaatctctcccttctcttaatttcaattcctttcattttctggtagagacaaaggagacacgttttatttgtggactcaaaactccagcgccggtcacagacttgggaaggcagccttcccttggtgtttaatcattgcagggacacctctctgattattcacccatgtttcagaggtgtctgaccacatggggacgcctgccttggtccttcacccttagaggcaagtaccgcttttctagggggcaagaacccctgatcccttatttccttgccctgacctcttatctctgtgccccgatcccttatttctgtgcaccgacctcttatctctgtgccctgatcccttatttccgtgccccgacctcttatctctgagccccgatcccttatttccatgccccgacctcttatctctctgcccaatcccttatttccgtgccccaatctcttatctctgcgccccaaccccttatttccatgcctcaacctcgtatctctgtgccccaaccccttatttccacaccctgacccgtttaccgcttttctagaaggtaagaacccctgaaccccttccctccctgtctctactctctcttttctctgggcttgcctccttcactatgggtaaccttccaccctccagtcctccttcttctcccttagcctatgttctcaagaacttaaaacctcttcaactcacacctgacctaaaacctaaatgccttattttcttctgcaatgctgcttgaccccagtacaaactcgacagtagttccaaatagccagaaaatggcactttcaatttttccatcctacaagatctaaataattcttgtcataaaataggcaaacggtctgaggtgcctgacgtccaggcattcttttacacatcagtccctccctagtctctgtgcccagtgtaactcgtcccaaatcttccttctttccctcccgcctgtcccctcactcccaaccccaagcgttgctgactctttctaatcttccttttctacagacccatctgacctctcccctcctcgccaggccgagctaggtcccaattcttcctcagcctccgctcctacaccctataatctttttatcacctcccctactcacacccggtctgtcttatagtttcgttccatgagtagccctcccccacctgcccagcaatttcctcttaaaaaggtggctggagctaaaggcatagtcaatgttaatgctcctttttatttatccgacctgtcccaaatcagttagtgtttaagctctttttcatcaactataaaaaacccagcccagttcatggccccattagcagcaaccctgagacactttacagccctagaccctaaaaggtcaaaaggacgtcttattctcaatatacattttattttattactgaatctgctcccaacattaaataaagctccaaaaattaaattccggccctcaaacctcacaacaagacttaattaacctcaccttcaaggtatacaatattagagtagaggcagccaagtagcaacatatttctaaattgcaattccttgcctgcactgagacaaaccccagccacatctccagcacacaagaactccaaatgcctgaactgcagctgccaagtgttcctccagaacccccaggagcttgctacaagtgccggaatctggccaccaggccaaggaatgcccacagcccgggattcctcctaagccgtgtcccatctgtgcaggaccccactgaaaatcagactgttcaacttacctggcagccactcccagagcccctggaactctggcccacggctctctgactgactccttcccagatcttctcggcttagcagctgaagactgatgctgcccgatcacctcggaagcctacaagaccatcacagatgctctaggtaactctcacagtggaaagtaagtccacccccttcttaatcaatacagaggctacccactccacattaccttcttttcaagggcctgtttcccttgcctccataattgttgtaggtattgatgtccaggcttctaaacctcttaaaactccccaactctggtgccaacttagaaaacattcttttatgcactcttttttagttatccccacctgcccagttcccttattaggccaagacattttaactaaattatctgcttccctgactgttcctggactatagccacacctcattgctgcccttttccccagttcaaagcctccttcacatcctcctctcgtatccccccaacttaacccacaagtataagatacctctactccctccttggcgaccgatcatgcaccccttacaatctcattaaaacctaatcaccctcacccctcaatgccaatatcccatcccacagcacgctttaaaaagatgaaagcctattatcactcacctgctacagcatggccttttaaagcctataaactccccttacaattcccccacttcacctgtcctaaaaccagacaaagcttacaggttagttcaagatctgtgccttatcaaccaaattgttttgcctatccaccccatggtgccaaacccatatactctcctatcctcaatatctccctccacaatccattattctgttctggatctcaaacatgctttcgttactattctttttcacccttcatcccagcctctcttcgttttcacttggactgaccctgacagccatcaggctcagcaaattacctaggctgtactgccacaaagcttcacagacagcccccattacttccatcaagcccaaatttcttcctcatctgttacctatctcgacataattctcataaaatcacatgtgctctccctgctgatcgtgtccggctaatctcccaaaccccaatcccttctacaaaacaacaactcctttccttcctaggcatggttagtgcggtcagaattcttacacaagagctgggactgcaccctgtagcctatctgtccaaacaacttgaccttattgttttagcctagccctcatgtctgcgtgcagtggccgccaccgccctaatacttttagaggccctcaaaatcacaaactatgctcaactcactctctacagctctcataatttccaaaatctattttcttcctcacacctgatgcatatactttctgctccccggctccttcagctgtactcactctttgttaagtctcccacaattaagattgttcctgtcccggacttcaatccggcctcccacattattccggataccacatctgacccccatgactgtatctctctgatccacctgacgttcaccccatttccccatatttccttctttcctgttcctcaccctgatcacacttagtttattgatggcagttccacaaggcctaatcgccacacaccagcaaaggcaggatatgctatagtacaagccactagcctgcctctcaaaacctctcattgtggtaatctgtcctcaaagaaataacttctcagtgttccatctgctattctactacttctcagggattcttcaggccccctcccttccctacacatcaaactcgaagatttgcccccacccaggactggcaaattagctttactcaacatgccccgagtcagataactaaaatacctcttagtctaggtagacactttcagtggataggtagaggcctttcctacagggtctgagaaggccactgcaggcatttcttcccttctgtcagacataattcctcactttagccttcccacctttgtacagtctgataacagaccagcctttattagtcaaatcagccaagcagtttttcaggctcttagtgttcagtgaaacctttatatcccttatggtcctcagtcttcaggaaaagtagaatggactaaaggtcttttaaaaacacacctcaccaagctcagccaccaacttaaaaaggactggacaatacttttaccactttcccttctcagaactcaggcctgtcctcagaatgctacagggtacagcccatttaaggtcctgcatagatgctcctttttattaggccccagtctcatcccagacaccagaccaacttagactgtgcctcaaaaaacttgtcatccctactattttctgtctagtcatactcctattcactgttctcaactactcatacatgccctgcttttgtttacactgtttctccaagccatcacagctgatatctcctggtgctatccccaaactgccactcttaactcttaaagtaaataaataatctttgccggcaaggctatgctgaccctctttaagcactctctaattagatgtcctaagtcctcccaattcttagtcctttaatacctgtatttctccttctcttattccgtttagtttttcaatccatacaaaaccgtatccaggccataaccagtaactctacatgacaaatgtttcttctaacaaccccacaatatcaccccttaccacaaaatcttccttcagcttaatctctcccactctaggttcccacgccgccccaatcccgctcgaagcagccctgagaaacatctcccattatctctccataccaccccccaaaattttcaccgtcccaacattttaccactatttcgttttatttttcttattgatataagaagacaggaatgtcaggcctctgagcccaagctaagccatcatatcccctgtgaccttcatgtacacatccagatggctggtttctgccttaactgatgacattctaccacaaaagaactgaaaatggcctgttcctgctttaactgatgacattatcttgtgaaattccttctcctggctcatcctggctcaaaagctcccctgctgagcaccttgtgaacaccccccacacctgcccgccagagaacaacccccctttgactgtaattttcctttacctacccaaatcttataaaacagccccacccctatttcccttcgctgattctcttttgggactcagcctgcctgcacccacgtgattaaaagctttattgctcacacaaagcctgtttggtggtctcttcacacagacacacatgaaa

SEQ ID NO: 597 - DNA, 3299 bp, Homo sapiens
tttctggtagagacataggaaacgtgttttatccgtggacccaaaactccagcgctggtcatggacttgggaagacagtcccaagtctttccattttttcctcagcctccgccccgccaccctacaatccttttatcacctccccctcctcacacctggtccagcttacagtttcgttctgcgactggccctcccccacctgcccagcaatttcctcttaaaaaggtggctggagctaaaggcatagtaaaggttaatgctcctttttctttatcggacctctcccaaatcagttagcgtttaggctctttttcatcaaatatgaaaaacccagcccagttcatggcccatttagcagcaacccttaagactctttacagccctagaccctgaagggtcagaaggccatctcattctaattatgcattttaacacccagtcagctcctgacattaaataaaactcctaaaattaaattccggccctcaaaccccacaacaggacttaattaacctctccttcaaggtgtacaataataaagtagaggcagccaagtagcaatgtatttctgagttgcaattccttgcctccactgtgagaaaaaccccagccacatctccagcacacaagaactccaaacacctgaactgcagctgccaggggttcctccagaacctcctcccccaggaacttgcttcaggtgccggaaatctggccactgggcgaaggaatgcctgaagcccgggattcctcctaagccttgtcccatctgtgcgggaccccactggaaatccaactcgcccagcagccactcccagagcccctggaactccggcccaaggctctctgactgactccttcccagatcttctcagcttcgtggctaaagactgatgctgcccgatcaccacagaagcctcctggaccatcacagatgctttaggtaactcttaaagtggagggtaagtccatccccttcttaatcaatacagaggctaccaactccacattaccttcttttcaagggcctgtttcctttgcctccataactgttgtgggtattgaagaccacgcttctaaaacctcttacactccccaactctggtgccaacttggacaatactcttttaagcactcctttttagttatccccacctgcccagctccctgaataggtcaaaacattttaactaaattatttgcttccctgactattcctgggctacagccacacctcattgttgccttttcccccagttcaaagcctccttcacacatcctccccttgtatctccccaccttaaaccgtagtatagtatacctctactccctccttggcaaccgatcatgcacctcttaccatcccattaaaacctagtcacccttaccccacttaatgccaatatcccatcccacagcacgctttaaaaggattaaagcctgttatcactcacctgttacagcatggacttttaaagcctataaactctccttacaattcccccattttacctgtccaaaaaccagacaagtcttacaggttagttcaggatctgcatcttatcaaccaaattgttttgcctatctaccccgtggtgccaaacccatatactctcctatcctcaatacctcccctccacaacccattattctgttctggatctcaaacatgctttctttactagtcctttgcacccttcatcccagcctctcttcgctttcacttggactgaccctaacacccatcaggctcagcaaattacctgggctgtactgccacaaggcttcacagacagcccccatcacctcagtcaagccagtgttcttacacaagagctgggaccgcgccctgtagcctttttatccaaacaatttgaccttactgttttagcctagccctcctgtctgcatgtggcggctaccgctgccttaatactttcagaggctttcaaaatcacaaactatgctcaactcactctctacagttctcataacttccaaaatctattttctttctcacacctgatgcatatactttctgcccaccccactacctctcagcaagccaaactcattgccttaacttgagccctcactcttccaaaaggactacacatcaatatttatactgactctaaatatgccttccatatcctgcaccaccatgctgttatataggcaaaaaaaaaaaaaaattcctcactatgcaagggtcctccatcactaatacctctttaataaaaactcttctcaaagccgctttacttctgaaggaagctggggtcattcactgcaagggccatcaaaaggcatcagatcccattgctcaggacaacgcttatgctgataaggtagctaaaaaagcagccatcaaaaagtatcagatcccatcgcccaggacaatgcttatgctaatagggcaactaaaaaaagcagccagcgttccaacttctatctcacagagcagtttttctccttctcatctggccactcccacctactcccccactgaaacttccacctatcaatctcttcccacacaaggcaagggtttttggaccaaggaaaatatatccttccagcctcacaggcccactctattctgtcgtcttttaatacctgtttttctcctcttattctgtttagtttttcaattcatacaaaaccatatccaggccatcaccaataattctatacgacaaatgctccttcaaacaaccccacaatatcacctcttaccacaaaatcttccttcagcttaatctctcccactctaggttcccatgccgctcctaatcccgccctgagaaacatcgcccattatctatccataccagccccaaaaattttcgctaccccaacactttaccactatttcgttttatttttcttattaatataagactacaggaatgttaggcctctgagcccaagctaagccatcatatgccctgtgacctgcacatatatatccggatggcctgaagtaactgaagaatcacaaaagaagtgaaaatagcctgttcctgccttaactgatgacattaccttgtgaaattccttctcctggctcatcctggctcgaaagctcccccaatgaacaccttgtgacccccaccaaagaacaacccgctttgactaattttcctttacctacccaaatcctataaaatggccccacccctttctccctttgctgactcttttcggactcagaccgcctgcacccaggtgattaaaaagctttattgctcacacaaagcctgttccgtggtctcttcacagggacatgagtgaaa

SEQ ID NO: 598 - DNA, 461 bp, Homo sapiens
gtcaggcctctgagcccaagctaagccatcatatccccagtgacctgcacgtatacatccagatggcctgaagcaactgaagatccacaaaaaaagtaaaaatagccttaactgatgacattccaccattgtgatttatttctgccccaacctaactgatcaatatactttgtaatctcccccacccttaggaaggttctttataatctcccccacccttaagaaggttctttgtaattctccccgcccttgagaatgtactttgtgagatccgccccctgctcccaaaacattgctcttaactccaccgcctatcccaaaacctataagaactaatgataatcccaccaccctttgccgactcctttttctgactcagcccgcctgcacccaggtgaaataaacagccatgttgctcacacaaagcctgcctttagtggtctcttcacagacacgtgaaa

SEQ ID NO: 599 - DNA, 966 bp, Homo sapiens
gtggggaaaagaaggagagatcagattgttactgtgtctgtgtagaaagaagtagacataggctaagactccattttgttctgtaactaagaaaaattcttctgccttgatatgctgttaatctgtaaccctacccccaaccctgtgctccctgaaacatgtgctgtgtcaactcagggttaaatggattaagggctgtgcaggttgtgtttcgttaaacaaatgcttgaaggcagcatgcttgttaagagtcatcaccactccctaatctcaaccactccctaagtacccagagacacaaaacactgcggaaggctgcagggacttctgcctaggaaagccaggtattgtccaaggtttctccccatgtgacagtctgaaatatggcctcgtgggaagggaaagacctgaccgtcccccagcccgacacccgtaaagggtctgtgctgaggaggattagtaaaagaggaaggaacgcctctttgcagttgagataagaggaaggcttctgtctcctgctcgttcctgggcaatggaatgtctcggtgtaaagccgattgtatattccatctactgagataggggaaaaccgccttagggctggaggtgggacatgctggcagcaatactgctctttaaggcattgagatgtttatgtatatgcacatcacaagcacagcacttttttctttaccttgtttatgatgcagagacatttgttcacgtgtttaccttctgaccttctctccactattaccctattatcctgccacatgcccctctctgggaaatgcccaataatgatcaataaatgctaagggaactcagaggccagtgccggcgtggatcctctgtatgctgaacgctggtcccctgggcccccttttttttctctatactttgtctctgtgtctctttcttttccaagtaacacccacaggtgtggaggggcaacccaccccttca

SEQ ID NO: 600 - DNA, 5883 bp, Homo sapiens
gtcaggcctctgagcccaagctaagccatcatatcccctgtgacctgcatgtacacatccagatggccggttcctgccttaactgatgacattccaccacaaaagaagtgaaaatggcctgttcctgccttaactgatgacattgtcttgtgaaattccttctcctggctcatcctggctcaaaagctcccctactgagcaccttgtgacccccactctgcccaccagagaacaaccccccctttgactgtaattttcctttacctacccaaatcctataaaacggccccacccctatctcccttcgctgactctcttttcggactcagcccgcctgcacccaggtgaaataaacagccatgttgctcacacaaagcctgtttggtggtctcttcacacggacgcacatgaaatttggtgccgtgactcagatcgggggacctcccttgggagatcaatcccctgtcctcctgctctttgcgaaagatccacctacgacctcaggtcctcggaccgaccagcccaagaaacatctcaccaatttcaaatccggtaagcggcctctttttactctcttctccaacctccctcactatccctcagcctctctcctttcaatcttggcgccacacttcaatctctcccttcttttaatttcaattcctttcattttctggtagagataaaggagacacgttttatccacggactcaaaactccggcgccggtcacagactagggaaggcagccttcccttggtgtttaatcattgcagggacacctctgattattctaccgggtttcagaggtgtcagaccacgcagggatgcctgccttggtccttcacccttagcggcaagtcctgcttttctggggaaggggcaagtaccctaatcccttctctccgtgtctctatcccttctccgcctttctggggggcaagaaacccccaaccccttctccttcacacttagcggcaagtcccacttttctagaggaggggcatgtaccccaacctcttatatctctgtgccccaatcccttatttctgtgccccgacctcttatctctgcaccccaatcccttatttctgtgccctgacctatctctgcaccccaatcccttatttctgtgccctgacctcttatctctgcaccccaatcccttatttctgtgccctgacctcttatctctgcaccccaatcccttatttctgtgccctgacctcttatctctgcaccccatcccttatttccgtgccccgacctcttatctctgcaacccgacctcttatctctgcatcccaaccccttatttccacgccccaacccctttcccgcttttctggaaggtaagaacccctgaaccccttccctccgtgtctctactctcttttctctaggcttgcttccttcactatgggcaaccttccaccctccattcctccttcttctcccttagcctgtgtcctcaaaaaacttaaaacctcttcaattctcacctgacctaaaatctaagcatcttattttcttctgcagtgctgcttgaccccaatacaaactcgacagtagttccaaatagccggaaaatggcactttcaatttttccatcctacaagatctaaataattcttgtcgtacaatgggcaaatggtctgaggtgcctgacatccaggcattcttttacacatcggtccctctctagtctctgttcccaatgcaactcgtcccaaatcttcctcctttccctcccgcctgtcccctcagtcccaaccccaagcgtcgctgagtctttctaatcttccttttctacagactcatctgacctctcccctcctccccaggctgctcctcgccaggccgagctaggtcccaattctttctcagcctccgctcctccaccctataatccttttatcacctcccctcctcacacacagtctggcttacagtttcgttccgtgactagccctccccacctgcccagcaatttactcttaaaaaggtggctggagctaaaggcatagtcaaggttaatgctcctttttctttatcccaaatcggatagcgtttaggctctttttcatcaaatataaaaatccagcccagttcatggctcgtttggcagcaaccctgagacgctttacagccctagaccctaaaagttcaaaaggccgtcttattctcaaaatacactttattacccaatctgctcccgacattaaagaaaactccaaaaattaaattccagccctcaaaccccacaacaggatttaattaacctcgccttcaaggtgtacaataatagagaaaagttgcaattccttgcctccactgtgagacaaaccccagccacatctccagcacacaagaacttccaaacgcctgaaccgcagcagccaggcgttcctccagaacctcctcccccaggagcttgctacaagtgccagaaatctggccaccaggccaaggaatgcctgcagcccaggattcctcctaagctgagtcccatctgtgcgggaccccactggaaatcggactgtctaactcacctggcagccactcccagcgcccctggaattctggcccaaggctctctgactgcttcccacatcttcttggcttagcggctgaagactgatgctgcccgatcgcctcggaagccccctacaagaccatcacggatgccgagcttcgcgtaactctcacagtggagggtaagtctgtccccttcttaatcaatacggaggctacccactccacattgccttcttttcaagggcctgtttcccttgcctccataactgttataggtattgacggccaggcttctaagcctcttaaaatcccccaactctagtgcccacttagacgttactcttttaaccactcctttttagttatccccacctgcccagttcccttattaggccgagacactttaactaaattatctgcttccctgactattcctggattacagctacatctcattgccgcccttcttcccaatccaaagcctcctttgtgtcctcctcttgtatcccccaaccttaacccacaaatataagatacctctactccctccttggtgaccgatcatgcaccccttaccatctcattaaaacctaataacccttaccctgctcaatgccaagatcccatcccacagcatgctttgaaaggattaaagcctgttatcactcgcctgctacagcatggccttttaaagcctataaactctccttataattcccccattttacctgtcctaaaaccagacaagccttacaagttagttcaggatctgcgccttatcaaccaaattgttttgcctatccaccccatggtgccaaacccatatactctcctatcctcaatacctctctccacagtccattattctgttctggatctcaaacatgctttctttactattcctttgcacctgtcctcctagcctctcttcgctttcacttggactgaccctgacacccgtcaggctcagcaaattacctgggctgtactgttgcaaagcttcacagacagcccccattacttcagtcaagcccaaattttctccttatctgttacctatctaagcataattcttataaaaacacacgtgctttccctgctgatagtgtccaattaatctcccaaacctcaattccttacaaaacagcaactcctttccttcctaggcatggttagtgcagtcagaattcttacacaagagccaggaccgcaccctgtagcctttctgtgcaaacaacttgaccttactgttttagcctagccatcatgtctccgtgcagcggctgccgccgtcctaatacttttagaggccctcaaaatcacaaactatgctcaacttactctctacatttctcataacttccaaaatctattttcttcctcatacctgacgcatatactttctgctccccggctccttcagctgtactcactctttgttaagtcccacaattaccattgttcctggcccggacttcaatccaccctcccacgttattcctgataccacacctgacccccatgactgtatctctctgatccacctgacattcactccatttccccatatttccttctttgccgttcctcaccctgatcacgcttgatttattgatggcagttccaccaggcctaatcgccacacaccagcaaaggcaggctatgctatagtacaagccactagcccgcctcttagaacctctcattttctttccatcgtagaaatctatcctcaaggaaataacttctcagtgttccatctgctattctactactcctcaaggattattcaggccccttcccttccccacacatcaagctcgaggatttgcccccacccaggactggcaaattagctttactcgacatgccccgagtcagataactaaaatacctcttagtctaggtagacactttcactggataagtacaggcctttcctacagggtctgagaaggccaccacagtcatttcctcccttctgtcagaaataattcttcagtttagccttcccacctctatacagtctgataacagaccagcctttattagtcaaatcagccaagcagtttttcaggctcttagtattcagtgaaacctttatatcccttacggtcctcagtcttcaggaaaagtagaacggactaaaggtcttttaaaaacacacttcaccaagctcagccaccaacttaaaaaggactggacaatacttttaccactttcccttctcagaagtcagacctgtcctcagaatgctacaaagtacagcctatttgagctcctgtatagacgctcctttttattaggccccagtctcattccagacaccagaccaacttagactgtgccccaaaaaaacttgtcatccctactatcttctgtctagtcatactcctattcaccattctcaactactcatacatgccctgctcttgtttacactgccggtttacactgtttctccaagccatcacagctgatatctcctggtgctatccccaaactgccactcttaactcttgaagtaaataaataatctttgctgacaggactatgctgaatttccttaggcactctaattagatgtcctaggtcctcccaattcttagacctttaatacctgtttttctccttctcttattccgtttagtttttcaattcatacaaaaaccgtatccaggccatcaccaataattctaaatgacaaatgtttcttctaacagtcccacaatatcaacccttaccacaaaatcttccttcggcttaatctctcccactctaggttaccacgccgcccctaatcccactcgaagcagccctgagaaacatcgcccattatctccccataccatccccaaaaattttcaccgtcccaacactttaccactattttgttttatttttcttattaacataagaagacaggaatgtcaggcctctgagcccaagctaagccatcatatcccctgtgacctgcaggtacacatccagatggccggttcctgccttaactgatgacattctaccacaaaagaagtgaaaatggcctgttcctgccttaactgatgacattgccttgtgaaattccttctcctagctcatcctggctcaaaagctcccctactgagcaccttgtgacccctactctgcccgccagagaacaaaccaacccctctttgactgtaattttcctttacctacccaaatcctataaaacggccccacccctatctcccttcgctgactctcttttcggactcagcccgcctgcacccaggtgaaataaacagccatgttgctcaaacaaagcctgtttggtggtctcttcacacggacgcacatgaaa

SEQ ID NO: 601 - DNA, 434 bp, Homo sapiens
gtcaggcctctgagcccaagctaagccatcctttcccctatgacctgcacctttacgtccagatggcctgaagcaactgaagaatcacaaaagaagtgaaaatgcccggttgctgccttaactgatgacattccaccattgtgatttgtttttgccccaccttaaccgagcgattaaccttgtgaaattccttctcctggctcaaaacctcccccactgagcaccttgtgacccccgcccctgcccacaagagaaaaatcccctttgactgtaattttccactacccacccaaatcctataaaacggccccacccctatctcccttccgtgactctcttttcagactcagcctgcctgcacccaggtgaaatagacagccttgttgctcacacaaagcctgtttggtggtctcttcacacggacatacgtgaaa

SEQ ID NO: 602 - DNA, 243 bp, Homo sapiens
tgggtcaggcacaaagtaagcccaccccactaggaactatgttaaaaaatgtcaagaaaggatttcagggagactatgcagtactgtgacaccaggaaaacttaaaactttgtgtaagatagactggctggcattagaggtgggttggccatcagaaggaagcctggacaggtcccttgtttcaaaagtatggcacaaggtaacctgtaagccaaggcacccaaaccagttcctgtacataga

SEQ ID NO: 603 - DNA, 967 bp, Homo sapiens
gtggggaaaagaaagagagatcagattgttactgtgtctgtgtaggaagaagtagacataggagactccattttgttctgtactaagacaaattcttctgccttgagatgctgttaatctataaccttagccccaaacccgaactctctgaaacatgtgctgtgtcaactcacggttaaatggattaagggctgtgctagatgtgctttgttaaacagatgctggaaggcggcatgctccttaagagtcatcaccactccctaatctcaagtacccagggacacaaacactgcggaaggccgcaggtacctctgcctaggaaagccaggtgttgtccaaggtttctccccatgtgatagtctgaaatatggcctcgtaggaagggaaagacctgaccgtcctccaacccgacacccgtaaagggtctgtgctgaggaggattagtataagaggaaggcatgcctctttgcagttgagacaagaggaaggcatctgtctcctgcccatccctgggcaatggaatgtcttggtataaaacccgattgtatgttccatctactgagataggggaaaactgccttagggctggaggtgggccatgcgggcaacaatactgctctgtaaggcattgagatatttatgtgtatgcatatctaaagcacagcacttaattctttaccttgtctatgatgcagagacctttgttcacgtgtttatctgctgaccttctctccactattatcctatgaccctgccacatccccgtctctgagaaacacctaagaatgatcaataaatactaagggaactcagaggctggcaggatcctccgtatgctgaacgctggtcccctgggctcccttatttctttctctatactttgtctctgtgtctttttcttttccaagtctctcgttccacctaacgagaaacacccacaggtgtggaggggcaacccaccccttca

SEQ ID NO: 604 - DNA, 714 bp, Homo sapiens
ttacagtaggtagctagtcagacatgagcagggcaggagagtgccaaaccccaccaggaatgtcaggcaaccatcaagtgtggtcaggtggcgttaagctgtctctctaaaataataattggtcacagccagtgccagagaaaagcagtctcccgatagatggaaaaaaacctgaaactggtgatcagcatcttcccaataagatttcaagatttggttgagtgggctcaagcatgtacactaagaggcaaaatggtggagtttaactggtgtgcgaccttctaggaacattgaactggtaagggaagaacgcctcaagtgagcatgcgtgcaactccagtaaacacgctgcacatgcagctccttccaagggctggcaggccactgtgcatgcagagagcccaccctaagggaagaatcaggagaggagagatgcaaactctggaagcatgccaacatttaaagccccaagtcaaaggtcaaactgcgcacttgatctctcaagtcgcctgcttggctctcttccaagtgtactttactcccttttgttcctgctctaaagctttttaataaactttcactcctgctctaaaacttgccttggtctctcactctgccctgtgcccctcggttgaattctttcttgtgaggaagcaagaactgaggttgctgcagacccgtatggattcgccgctgctaacataatttggtacc

SEQ ID NO: 605 - DNA, 769 bp, Homo sapiens
gagagacaggactagctggatttcctaggccgactaagaattcctaagcctagctggggaaggtgaccgcacccgcttttaaacacagggcttgtaactcagctcacacctgaccaatcaggaagtaaagacagctcactaaaataccaattaggctaaaagcaggaggtaaagaaatactcaatcatctatcgcctgagagcacagggagagacaatgaccgggatataaacccaggcattggatccggtgtggcaaccccctttgggtcccctccccttgtatgggagctctgttttcactctattatatcttgcaactgcgcgctcttctggtccgtgtttgttctggctcgagctgagctttcactcaccgtccgccactgctgattgctgccgtcgcagacccgccactgacttccaccctccagatccagcccggtgcctgctgtgctcctgatccagcgaggcgcccgttgccgctcccggtcgggctagaggctcgccattgttgctgcgcggctaagtgcccaggttcatcctaattgagctgaacgctagtcgctgggttccacggttctcttctgtgacccacggcttctaatagagctataacaactcacctcatggcccaacgttccattccctggaatccgtgaggccaagaaccccaggtcagggaacaaaaggcttgtgccatcttgggagcggcccccccaccatcttgggagctctaagaacaaagacctgctggtaacacaattttggta

SEQ ID NO: 606 - DNA, 290 bp, Homo sapiens
gacttggatcggggggcctcccttgggagatcaatcccccgtcctcctgctttttgctccttgagaaagatccacctaggacctcaggtcctcagaccgaccagcccaagatacatctcaccaatttcaaatccgccactcccagagcccctggaactctggcccaaggctctctgactccttcccagatcttctcggcttagcggctgaagactgacactgcccgatcgcctcggaagccctctaccccatcacggacgccgagctttcggtaactcttacggtggaag

SEQ ID NO: 607 - DNA, 967 bp, Homo sapiens
gtggggaaaagcaagagagatcagattgttactgtgtctgtgcagaaagaagtagacataggagactccattttgttatgtactaagaaaaattcttctgccttgagattctgttaatctataaccttacccccaaccctgtgctctctgaaacatgtgctgtgtcaactcagagttaaatggattaagggcggtgcaagatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgactgtcccccagcccgacacccgtaaagggtctgtgctgaggaggattagtaaaagaggaaggaatgcctcttgcagttgagacaagaggaaggcatctgtctcctgcccgtccctgggcaatggaatgtctcggtataaaacccggttgtatgctccatctactgagatagggaaaaaccgccttagggctggaggtgggacctgcgggcagcaatacggttttgtaaagcattgagatgtttatgtgtatgcatatctaaaagcacagcacttaatcctttacattctctatgatgcaaagacctttgttcacgtgtttgtctgctgaccctctccccacaattgtcttgtgaccctgacacatccccctcttcgagaaacacccacaaatgatgaataaatactaagggaactcagaggctggcgggatcctccatatggtgagcgctggttccctgggtccccttatttctttctctatactttgtctctgtgtctttttctttcctaagtctctcattccaccttacgagaaacacccacaggtgtggaggggcaacccacccctaca

SEQ ID NO: 608 - DNA, 738 bp, Homo sapiens
catcagatggccaaatcattatttactggaccagaccttttcaaaactatcaagcagatagtcaaggcctgtaaagtgtgccaaagaaataatcccctgcactgcaggccatacatttcaatccctctatctttaacctccttgttaagtttgtctcttccagaattgaagctgtaaaactacaaatcgttcttcaaatggagccccagacagtccatgactaaaatctaccacagacccctggaccggcctgctagcccatgctccaatgttaatgacattgaaggcacccctcctgaggaaatctcaactgcacaacccctactacgtcccaattcagcgggaagcagttagagtggttgtcggccaacctccccaacagcacttgggttttcctgttgagagggggcactgagagacaggactagctggatttcctaggccgacaaagaatccctaagcctagctgggaaggtgaccgcttccacctttaaacacagggcttgcaacttagctcacacctgaccaatcagatagtaaagagagctcactaaaatgctaattaggcaaaaacaggaggtaaagaaatagccaatcatctgttgcctgagagcacagagggagggacaacgatcaggaaataaacccagacattcgagctggcaacagcaaccccctttgggtcccctccctttgtatgggagctctgttttcactctattaaatcttgcaactgca

SEQ ID NO: 609 - DNA, 974 bp, Homo sapiens
gtgggggaaagaaagagagatcagactgttactgtgtctatgtagaaaggagtagacataagaaactccattttgttctgtactaagaaaaattcttctgccttgagatgctgttaatctgtaaccctagcctcaaccctgtgctcgcagagacatgtgctgtgttgactcaaggtttaatggatttagggctgtgcaggatgtgctttgttatgaagtgtttgcaggcagtatgcttggtaaaagtcatcgccattctccagtcttgagtacccagggacacaatgccctgtggaaggccgcagggacctctgcctaggaaagccaggtgttgtccagggtttctccccactgagacagcctgagatatggcctcgtgggaagggaaagacctgaccatcccccagcctgacacccgtaaagggtctgtgctgaggaggattagtgaaagaggaaggcctctgcagttgagataagaggaaagcatctgtctcctgctcctccctgggaatggaatgtcttggtgttaaacccgatcatacattctatttactgagataggagaaaaccgccttatggctggaggtgagacatgctggcggcaatactgctctttactgcactgagatgtttgtgtaaagtcaaacataaatctggcgtacgtgcacatccaggcacagcacctttccttaaacttatttatgacacagagacctttgctcacatgttttcctgctgaccctctccccaccattaccctatagtcctgccacatagccctcaccaagatggtagagatagtgatcaataaatactgagggaactcagagaccagtgctggcatgggtcctccatatgctgagcgctggtcccctgggcccactgttctttctttatactttttctctgtgtcttatttcttttctcagtctctggtcccacctgacgggaaatacccacaggtgtggaggggc

SEQ ID NO: 610 - DNA, 938 bp, Homo sapiens
ttagagtagctagtcaggcagacatgaggagggccaagagggctcttccccatccaccagaaatgtcaggcgactttcaggtgatggtcaggcagtttttaattgtctcgttaaaataataattggttgcagctggcaccagagaaaggcagtctcctaatggatagaaaaaaccttggccgggcgcggtggctcacgcctgtaatcccagaactttgggaggccgagatgggcggatcacgaggtcagatcgagaccatcctggctaacacggtgaaaccccatctctactaaaaaaatacaaaaaaattagccgggcgtggcggcgggtggcgcctgtagtcccagcactctggaggctgaggcaggagaatggtgtgaacctgggaggcagagcttgcagtgtgcccagatagcgccactgccctccagcctgggagacagagcgagactccgtctcaacaaaaaaaaaaaaaaagaaaaaaagaaaagaccttaaactggtgatcagcagcttcctgattagatctcaggagttgggtgagtgggctcaagcctgtgcactaagaggcaaaatggcggagtgtatgtaactggtatatgaccttcttctaggaacacgtgactgggaagggcaaaacgcctccagtgagcatgcgcacaacttcagtaaacacactgtgcctgcagcccctcccaagtgctggcaggccactgcgcatgcagacagcccacctcaagggaagaatcaggggagaaggaatgcaagaccccggaagcaaccccaagtcaaaggtcaaactgtgcacttgatctctcaagttgcccgactggccctcttccaagtgtactttacttcgtttcattcctgctctaaagcttttaaatacagtttcactcctgctctaaagcctgcctccttctttccctctgcctta

SEQ ID NO: 611 - DNA, 2741 bp, Homo sapiens
tgggtcaggtgcaaagtaagcccaccccactgggacctatgttaaaaaaattttttttcaagagagaatttaaaggagattacggtgttagtatgacaccaggaaaacttagaactttgtgtgaaatagactggctagcattagaggtaggttggccaccagaaggaagcctggacaggtcccttgtttcaaaggtatggcacaaggtaacctgtaagccaaagcacccagaccggtttctgtacatagacagttacagctggttttagaccccctttcccccaccacagtagttaagagaacagcagcataagcggctggcagagccaaggaacgaccagaaaagagaaaaagaggccatctgtaccaattctaagagtttagactaaacaagttcttattaatagcaaaggataattgaaatctcaaacttacaaggttttcaacaaaagtgaagtttgctaaaagttaacagtgtaacatgtattttggtaacttctaatcttgtggccttagacagtctagtccaaagacataaagaaagttcgcttttttaaaaaggaaagaaaaggggggaggcagaatttatattaaaaaaaagttatatggtaaattcttgtcctgaaataaattaactggttgtttaaagaaaaaaaagtttgttaatcagtcaaaaaattgagacatgttaaaaaattgtctgggaaagtcgtgagaaaaaaattataaaaaaaaatttttatgcaaaaaatattgtataatttaaaagtaatgaggcctcctgagtactatttaaaaaaaaaaaaccagttcatgtgcaagatgtataagaaaagtaaaatatacctttggtaaaaaaaaaaattataaaggggcataaacgtggatttttacctacattaaaaggttaaaaaaattattgttttaaaagtttaagcaagctttaaaacgttaattataaaaaaaattctgtgtgtaaacatattagctaaggttaaaaaggtatcatccagtttttctgtgaactggacattaaagtaaaaatgcaagaggtttttcttaaagcatcaacctgctctttaacaaaaattataaaaggttaaaaagagtctataaaatcttaccttatggtcaaacataaaaaattggataaatatgtctacaaggttttattaaaattaagtttaacattaataacacactaatataaaggtaaaatttagcttatctggtataaaagtcatacaggaagcattagtaaatataaaatagtgtttagctttcttttgtctaaaaactaataaaaattggtgctaaaggaagcattcattttactagaggatcataaaagttaaagacttaaaacaaactttggcaattaagacagcataccaagatgcaaatgcctggttgaaatggatcaaatattccatctgcaggttaaacaaaagcaattagcatgcttgtgcacatggcaggccagaggccctgattgtcccccttccactaaggtggtcctccagtcggccaggcatgggctgcatggtagctcttttccaggattctatagcctggagtaataagtcatgccaagctctctctgctatatcccaaagtccctgcaggtcagcccccgagggccatccagcttccatctcccaacactaagttcactacgtgtctctcatggcagggaggagacttagcattccttggagacctgaagggatgcagtgagcttaagaattttcaagagcttatcaatcagtcagcccttgttcatcccaaagcggatgtgtggtggtattgtggtagacctttattggggactctgccgagtaactagagtggcacttgtgctttagtccatttggctatccctttcaccctgacatttcatcaacaagaggaaaaaataataataagaagaagacatcataaagcgagaaaagctccttataggtctttcaactctcacatctatttagatgcaattgaagccccgcaaggagtcccagatcaatttaaagcttgaaatcaaatagttacaggatttaagtcaatattttggtagatgacagtcaataaaaatgtagattagataaactacatctattacaaccaacagcaacgagcttttcatgagttaaaaagaaaaactcatgtcggccccagccctgaggctacctgacctgacaaaactctttacgctctatgtgtcagaaacaaaaaaaatggcagttagagttttaacccagactgtagggccctggccaaggccagtggcctatctctcaaaacaactagatggggtttccaaaggctggcccccatgtccaagggccctggtagcaacggccctgtcacaagaagcagataagctaactcttacacaaaacctaaacataaactccccccatgctgtggtgattttaataaataccaaaggacaccatgctagatgaatgctagactaactagatgccaaagctagctctgtgaaaatccccacataaccattgacgtttgcacaccctaaaccctgccaccttcctcctggtatcagagagcccagttaaccatatctggactcagtttattctagtaggcccaaccaccgagaccacccttaaacatcagtaggctgggagctgtacatggatgggagcagcttcgccaacccctgcaaagtgactctgaagaagacgacaagccctgctccagtcacacctggaagctga

SEQ ID NO: 612 - DNA, 237 bp, Homo sapiens
gccttaactgatgacattatcgtgtgaaattccttctcctggctcatcctggctcaaaagatcccctactgagtaccttgtgacccccactcctgcccgccagagaacaaccccctttgactataattttcctttacctacccaaatcttataaaacggccccacccctatctcccttcgctgaatctcagcccgcctgcacctaggtgaaataaacagccttgttgctcaaaaaaa

SEQ ID NO: 613 - DNA, 12115 bp, Homo sapiens
gtcaggcctctgagcccaagccaagccatcgcatcccctatgacttacacgtgtacatccagatggcctgaagtaactaaagatccacaaaagaagtaaaaatagccttaactgatgacattccaccattgtgatttgtttctgccccacccgaactgatcaatgtactttgtaatctcccccacccttaagaaggttctttgaaattctccccactcttgaggatgtactttgtgagatccacccctgcccgcaaaacattgctcttaacttcaccgcctatcccaaaacccataagaactaatgataatccaccaccctttgccgactctcttttcggactcagcccgcctgcacccaggtgaaataaacagccatgttgctcacacaaagcctgtttggtggtctcttcacatggacgcgcatgaaatttggtgccgtgactcagatcgggagacctcccttgggagatcaatcccctatcctcctgctctttgctccatgagaaagatccacctacgacctcaggtcctcagacccaccagcccaagaaacatctcaccaatttcaaatccaataagcagcctctttttactctcttctccaacctccctatccctcaccgtctttctcctttcaatctaggcgccacacttcaatctctcccttctcttaatttcaattcctttcattttctggtagagacaaaggagacgttttatctgtggacccaaaaaaccggcgccggtcacggactgggaaggcagccttcccttggtgtttaatcattgcaaggacgcctctgatcattcacccacgtttcagaggtgtcagaccacgcagggacacctgccttggtccataacccttagcggcaagtcccgcttttctgaggaaggggcaaggaccccaaccccttctttccgtgtctctaccccttctctgattttctggggcaggggcaagaaccccccaaccccttctccttcacccttagcggcaagtcccgcttttctgggggagaggcaagtaccccaaactcgtatctctgtgccccaatcccttatttccatgccccaacccctttcccgcttttctggagggtaagaacccccaaaccccttccctccatgtctctacgctctcttttctctgggcttgcctccttcactatgggcaaccttcctacattcctccttcttctcccttagcctgtgttctcaagaacttaaaacctcttcaactcatacctgacctaaaacctaaataaatgccttattttcttctgcaatgccgcttgaccccaatacaaactcgacagtagttccaaatagccagaaaacggcactttcaatttttccatcctgcaagatctaaataattcttgtcgtaaaatgggcaaacagtctgaggtgcctgatgtccaggcattcttttacacatcagtcccttcctagtctctgtgcccagtgcaactcgtcccaaatcttccttctttccctcccgcctgtcccctcagtcccaaccccaagcgttgctgagtctttctaatcttccttttctacagacccatctgacctctcccctcctcgccaggccgagctaggttccaattcttcctcagcccctagaccctaaaaggtcaaaaggccgtcttattctcaatatacattttattacccaatctgctcccgacattaaataaaactccaaaaattagaatctggccctcaaactccacaacaggacttaattaacctcaccttcaaggtgtacaataatagaaaaaagttgcaattccttgcctccactgtgagacaaaccccagccacatctccagcacacaagaacttccaaatgcctgaaccgcagcggccaggcgttcctccagaacctcctcccccaggagcttgctacacgtgccagaaatctgactaccagggccaaggaatgcctgcagcccaggattcctcctaagccgtgtcccatctgtgcgggaccccactggaaatcggactgttcaactcacctggcagccactcccagagcccctagaactctggcccaaggctctctgactgactccttggcttagcggctgaagattgacgctgcccaatcgccttggaagcccccagaccatcacggacgccaagctttgggtaactctcacagtggagggtaagtccacccactgtttaatcgaaacggggactacccactccatgttgccttcttttcaagggcctgtttcccttgcctccataactgttgtgggtatggacggccaggcttctaaacctcttaaaactccccaactctggtgccaacttagacattactctttgaagcactcatttttagttatccccacctgcccagttcccttattaggccgagatattttaagcaaattatctgcttccctgactattcctggactacagccgcatctcattgccgcccttctccccaacccaaagcctcctttgcgtcttcctctcatatccccccaccttaacccacaaatatgggacatttctactccttccctgacaactgatcacatgcccattaccatcccattaaaacctaatcacccttaccccgctcaacgccaatatcccatcccacagcacgctttaaaaggattaaagcctgttatcactggcctgctacagcataggcttctaaaacctataaactcttcttataatccccccattttacctgtccagaaaccggacaagtcttacagattagttcaggatctgcgccttatcaaccaaattgttttgcctatccaccctgtggtgcccaacccatacactctttcatcctcaataccttcctccacaactcactattccacacttgatcttaaagatgcttctttcagcgttcccctgcaccccttgtcccagcctctctttgctttcacctggactgaccctgacacccatcagtcccagcagcttacctgggctgtgctgccacaaggtttcagggacagccctcattacttcagccaagctctttctcatgatctactttctttccacccctccgcttctcaccttatttaatatattgatgaccttcttctttgtagcccctcctttgaatcttctcaacaagacacacttctgctccttcagcatttactctccaaaggatatcaggtatccccctccaaagctcaaatttcatcctcatctgttacctatctcggcataattctcataaaaacacacgtgctctgcctgttgatcttgtctgattaatctcccaaacctcaatcccttccaaaacaacaactcccttccttcctaggcatggttagtgcggtcagaattcttacacaacagccaggaccacaccctgtagcctttctgtccaaacaacttgaccttactgttttagcctagccctcatgtctgcgtgcagcggctgccgctgctttaatacttttagaggccgtaaaaatcacaaactatgctcaactcactctctacatttctcataacttccaaaatccattttcttcctcatacctgatgcatatactttctgctccccggctccttcagctgtactcactctttgttaagtcccacaattaccattgttcctggcccggacctcaatctggcctcccacattattcctgataccacacctgacccccatgactgtgtttctctgatccacctgacattcaccccatttccccatatttccttctttcctgttcctcaccctgatcacgcttgatttattgatggcggttccaccaggcctaatcgccacatagcagcaaaggcaggctatgctatagtacaagccactagcccgcctcttagaacctctcatttcctttccatcgtggaaatctatcctcaaggaaataacttctcagtgttccatctgctattctactactcctcagggattattcaggccccttcccttccctacacatcaagcttgaagatttgcccccacccaggactggcaaattagcttcactcaacatgccccgagtcagataactaaaatacctcttagtctaagtagacactttcactagataagtagaggcctttcctacagggtctgagaaggccaccgcagtcatttcttcccttctgtcagacataattcctcagtttagccttcccacctctatacagtctgataacggaccagcctttactagtcaaatcacccaagcagtttctcaggctcttagtattcagtggaaccttcatatcccttacagtcctcaatcttcaggaaaggtagaacggactaatggtcttttaaaggtacacatcaccaagctcagcctccaacttaaaaaggattggacagtacttttacttcttgctcttctcagaattagagcctgttctcgagatgctacagggtaggtacagtccatttgaacttttatatggacgcactttcttgcttggccccaacctcatcccagacaccagccctctaggcgactgtcttccagtcctccagcaggctagacaggaaattcgccaggctgctaagcttctcttgcctactccagatccccagccatatgaagacaccctagctggacgatcagttcttgttaatctgactcctcaaactctacaacctcgatggaccggaccctacttagtcatctatagtaccccgactgctgtccgcctgcaggatcctccccactaggctcaccgttccagaataaagctgtgtccatcggacagccagcctaatccctcctcttcctcctggaagttgcaagtactctcccctacttcccttaaactcagtcgtatttcgaagaacagtcataacccttatgagcctaatacatcccttcattctattaggtttttcgtccttaccctactttttgcaacagggctttacgaagtcacccccaccacttaggccgagccccaaaaaactagtcatccctactatcttctgtctggtcatactcctattctccattctcaactacttataaatgccctactcttgtttacacggccggtttacactgtttcttcaagccatcacagctgatatctcttggtgctatccccaaactgccactcttaactccctcttagagtggatagatgatctttgctggcaaggcaccctccaatatttccaccctgatgaagttctattctttacttttatactcactcttattctcattcccattcttatgccaccctctacctctccccagctatctccaccacactatcaaccttacccattctctcctagccgcttctaatccctccttagtgaacaactgctggctttgcatttccctttcttccagtgcctacacagctgtccccaccttacagacagactgggcaacatctcccatctccctacacctccgaacttcctgtaacagccctcacctttaccctcctgaagaactcatttactttctagacaggtccagcaagacttccccagacatttcacatcagcaagctgccgccctccttcacacttatttaaaaaacctttctcctttctcctttctccccccatattcggacctctcacaacacaaactactatgcctgtggccgctcctatatgtatctctcggcaaagacccactggaattcccctaggtaatctttcaccttctcgatgttcctttactcttcatctccaaagtccaactacacacatcactcaaacaatgggagccttccagctccatattacagacaagcccgctatcaatactgacaaacttaaaaacattagcagtaattattgcttaggaagacacttgccctgtatttcactccatccttggctactttccccttgctcatcagactcttcctcccaggccctcctcttgtttacttttacccagccccgaaaataatagtgaaaggttgcttgtagatactcaacgttttctcatacaccatgaaaatcgaacctccccctctatgcagttaccccatcagtccccattacaacctctgacagctgccgccctagctggatccctaggactctaggtacaagacaccccttgcagcactcctcatctttttactttacatctccagttttgcctcgcacaaggtctcttcttcctctgtggatcctttacctaacatgtgtctacctgctaattggacaggcacatgcacactagtcttccttactcccaaaattcaatttgcaaataggaacgaagagctccctgttcccctcatgacaccgacacaacaaagaagagtcattccactaattcccttgatggtcggtttaggactttctgcctccactattgctctcggtactggaatagcaggcatttcaacctctgtcatgaccttccgtagcctgtctaatgacttctctgctagcatcacagacatgtcacaaactttatcagtcctccaggcccaagttgactctttagctgcagttgtcctccaaaaccaccgaggccttgcttactcactgttgaaaaaagaggactctgcatattcttaaatgaagagtgttgtttttacctaaatcaatctggcctgatgtatgacaacataaaaaaactcaagcatagagcccaaaaacttgccaaccaagcaagtaattacgctgaacccccttacgcactctctaattggatgtcctaggtcctcccaattcttagtcctttaatacccatttttctccttcttttatttggaccttggatcttctgtttagtttctcaattcatccaaaactgtatccagaccatcaccaatcattctatacaacaaatgtttcttctaacatccccacaatatcaccccttaccacaagacctcccttcagcttaatctctcccactctaggttcccacgccgcccctaatcccgcttgaagcagccctgagaaacatcgcccattctgtctccataccaccccccaaaaattttcaccgccccaatacttcaacactattttatttttcttattaacataagaaggcaggaatgtcaggcctctgagcccaagccaagccatcgcatcccctatgacttgcacgtatacatccagatggcctgaagtaaatgaagatccacaaaagaagtaaaaatagccttagctgatgacattccaccattgtgatttgtttctgccccacccgaactgatcaatgtactttgtaatctcccccacccttaagaaggttctttgtaattctccccactcttgagaatgtactttgtgagatccactcctgcccacaaaacattgctcttaacttcaccgcctatcccaaaacccataagaactaatgataatccaccaccctttgctgactctcttttcggactcagcccgcctgcacccaggtgaaataaacagccatgttgctcacacaaagcctgtttggtggtctcttcacacggacgcgcatgaaacacttcaatctctcccttaatttcaattcctttcattttctggtagagacaaaggagacacattttatctgtggactcaaaactccggcgccggtcagagactgggaaggcagccttcccttggtgtttaatcactgcagggacgcctgattatttacccacgtttcaaaggtgtcagaccatgcagggacgcctgccttggtccttcacccttagcggcaagtcccacttttctggcggagaggcaagtacaccaaccccttctctccgtgtctctaccccttctctgcttttctaggggaggggtaagtaccccaaccccatgtatctctgcgccccgatcccttatttctgcgccccaatctcttatatctctgtgccccaatcccttatttccgtgccccaaccccttctctgcttttctggagggcaagaaccccccaccccttctccgtgtctctactcttttctctgggcttacctccttcactatgggcaagcttccaccttccattcctttcttctcccttagcctgtgttcttaagaacttaaaacctcttcaactcacacctgacctaaaacctaaataaatgccttattttcttctgcaattccacttgaccccaatacaaactcgacagtagttccaaatagccagaaaacggcactttcagtttttccatcctacaagatctaaataattcttgtcgtaaaatgggcaaacggtctgaggtgcctgatgtccaggcattcttttacacatcagtcccttcctagtctctgtgcccagtgcaactcgtcccaaatcttccttctttccctcccacctgtcccctcagtcgcaaccccaagcgtcgctgagtctttctaatattccttttctacagacccatctgacctctcctcctcgccaggctgagctaggttccaattcttcctcagcctccgctcctccaccctataatccttttatcacctcccctcctcacacctggaccagcttacagttcattctgtgactggccctcccccacctgcccagcaatttactcttgaaaaggtggctggagctaaaggcatagtcaaagttaatgctcctttttctttatcccaaatcagatagcgtttaggttctttttcatcaaatataaaaatccagcccagttcatggctcgtttggcagcaaccctgacacgctttacagccctagaccctaaaaggtcaaaaggccgtcttattctcaatatacattttattacccaatctgctcccgacattaaataaaactccaaaaattagaatctggccctcaaaccccataacaggacttaactaacctcaccttcaaggtggacagtaatagaaaaaagtggcaattccttgcctccactgtgagacaaaccccagccacatctccagcacacaagaacttccaaacgcctgaaccgcagcagccaggcgttcctccagaacctcctcccccaggagcttgctacacgtgctggaaatctggccactgggccaaggaatgcccacagcccgggattcctcctaagccgcgtcccatctgtgcgggaccccatgaaaatcagactgttcaactcacctggcagccactccccagagcccctggaactctggcccaaggctctctgactccttcccagatctcggcttagcagctgaagactgacactgcccaatcccctcggaagccccataaaccatcacggacgccgagcatcgggtaactctcacagtggagggtaagtccatccccttcttaatcaatacggaggctacccactccacattaccttcttttcaagggcctgtttcccttgcctccgtaactgttgtgggtattgacggccaggcttctaaacctcttaaaactccccaactctggtgccaatttagacattactcttttaagcactccttttcagttatccccacctgcccagttcccttattaggccgagacactttaaattatctgcttccctgagtattcctgaactacagctacatctcattgccgcccttcttcccaatccaaagcctcctttgtgtcctcctcttgtatcccccaaccttaacccacaagtataagatacctctactccctccttggcaaccaatcatgcaccccttaccatctcattaaaacctaatcacccttaccccactcaatgtcccatcccatggcacgctttaaaaggattaaagcctgttatcactcgcctgctacagcatggccttttaaaacctataaactctccttacaattcccccattttacctgtcctaaaaccagacaaggcttacaggttacttcagaatctgcgcgttatcaaccaaattgttttgcctatccaccccgtggtgccaaacccatatactctcctgtcctcaatacctccatctactacccattattctgttctggatctcaaacatgctttctttactattcctttgcacccttcatcccagcgtctctttgctttcagttagatgaccctgacacccatcaggctcagcaaattacctgggctgtacggccacaaggcttcacagacagcccccactacttcagtcaagcccaaatttcatccccatctgttacctatctcggcataattctcataaaaacacacgtgctctccctgttgatcgtgtctgattaatctcccaaacctcaatcccttacaaaacaacaactcccttccttcctaggcatggttagtgcggtcagaattcttacacaacagccaggaccacaccctgtagcctttctgtccaaacaacttgaccttactgttttagcctagccctcatgtctgcgtgcagcggctgccgctgctttaatacttttagaggccgtaaaaatcacaaactatgctcaactcactctctacatttctcgtaacttccaaaatctactttcttcctcatacctgatgcatatactttctgctccccggctccttcagctgtactcactctttgttaagtcccacaattaccattgttcctggcccggacctcaatctggcctcccacattattcctgataccacacctgacccccatgactgtatctctctgatccacctgatattcaccccatttccccatatttccttctttcctgttcctcaccctgatcacgcttgatttattgatggcggttccaccaggcctaatcgccacatagcagcaaaggcaggctatgctatagtacaagccactagcccgcctcttagaacgtctcatttcctttccatcgtggaaatctatcctcaaggaaataacttctcagtgttccatctgctattctactactcctcagggattattcaggccccctcccttccctacacatcaagcttgaagatttgcccccacccaggactggcaaattagcttcactcaacatgccccgagtcaggtaactaaaatacctcttactctaagtagacactttcactagataagtagaggcctttcctacagggtctgagaaggccaccgcagtcatttcttcccttctgtcagacataattcctcagtttagccttcccacctctatacagtctgataacggaccagcctttactagtcaaatcacccaagcagtttctcaggctcttagtattcagtggaaccttcatatcccttacagtcctcaatcttcaggaaaggtagaatggactaaaggtcttttaaaaacacacctcaccaagctcagcctccaacttaaaaaggactggacaatacttttaccactttcccttctcagaattcaggcctgtcctcagaatgctacaaggtacagcccatgtaagctcctgtatagacgctcctttttattaggccccagtctcattccagacaccagaccaacttagactgtgccccccaaaacttgtcatccctactatctcctgtctagtcatattcctattcgccattctcaactactcatacatgccctgctcttgtttacactgccggtttacactgtttctccaagccatcacagctgatatctcctggtgctatccccaaactgccactctaaactcttgaggtaaataaataatctttgctggcaggactatgctgaatctccttaggcactctctaatcagatgtcataggtcctcccaattcttagaccttttatacctgtttttctccttctcttattccatttagtttctgaattcatccaaaaccgtatccaggccatcaccaatcattctatacgacagatgtttcttctaacatccccacaatatcaccccttaccacaagacctcccttcagcttaatctctcccactctaggttcccacgccgcccctaatcccgcttgaagcagccctgagaaacatcgtccattctctctccataccaccccctaaaaattttcaccgccccaacacttcaacactattttatttttcttattaatataagaaggcaggaatgtcaggcctctgagcccaagccaagccatcgcatcccctgtgacttgcacgtatacatccagatggcctgaagtaactgaagatccgcaaaagtaaaaatagccttaactgatgacatcccaccat

SEQ ID NO: 614 - DNA, 958 bp, Homo sapiens
gtggggaaaagcaagagagatcagattgttactgtgtctgtgtagaaagaagtagacataggagactccattttgttctgtactaagaaaaattcttctgccttgagattctgttaatctataaccttacccccaaccccgtgctctctgaaacatgtgctgtgtcaactcagagttaaatggattaaggtcggtgcaagatgtgctttgttaaacagatgcttgaaggcagcacgctccttgagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagaccccagcccgacacccgtaaagggtctgtgctgaggaggattagtataagaggaaggcatgcctcttgcagttgagacaagaggaaggcatctgtctcctgcctgtccctgggcaatggaatgtctcggtataaaacccgattgtatgttccgtctactgagatagggaaaaaccgccttagggctggaggtgggaactgcgggcagcaatactgctttgtaaagcattgagatgtttatgtgtatgcatatctaaaagcacagcacttaatcctttacattgtctacgatgcaaagacctttgttcacgtgtttgtctgctgaccctctcccgacaattgtcttgtgaccctgacacatccccctctcggagaaacacccacgaatgatcaataaatactaagggaactcagaggctggcgggatcctccataatgctgaacgctggttccccgggtccccttatttctttctctatacattgtctctgtgtctttttctttcttaagtctctcgttccaccttacgagaaacacccacaggtgtggaggggcaacccacccctaca

SEQ ID NO: 615 - DNA, 961 bp, Homo sapiens
gtggggaaaagaaagagagatcagattgttactgtgtctatgtagaaaacagaagacataagaaactccattttgttctgctttgagatgctgttaatctgtaacttttgtcccaaccttgtgctcacaaaaacatgtgctgtattgaatcaaggtttaatggatctagggctgtgcaggatgtgccttggtaaaaatgtgtttgcaggcagtatgctttgtaaaagtcatcgccattctccattctctattaactagagacacaatgcactgcggaaggccgcaggaacccctgcccaagaaagcctgggtattgtccaggtttccccccactgagacaacctgagatacggcctcgtgggaagggaaagaccttacagccccccagcccgacatccgtaaagggtctgtgctgaggaggattagtgaaagaagaaggcctcaatgcggttgagataagaggaaggcgtctgtctcccgcacgtccctgggaatggaatgacaaatgtaaaaccaaccatacattctactctaagagaaaatcgccttatggatacaggtgagacatcatggcagcaatactactctttactgcactgagatgtttatgtaaagttaaatataaatctagcctacgtgtacatttaggcccagcacttttccttaaacttatttatgacacagattcctttactcacatgtttttctgctgaccctctccccaccttcaccctatagccccaccacattcccctcgccaagataggaaaaatagtgatcaataaatactgagagaactcagagactcagagtaagtgagcaccggtgttggtcctcacttactaagcgccggtcccccagggcccacttttcttcctctgtactttgtctctgtgtcttatttcttttctcagtctctcatctccaccttgcaagaaatacccacaggagtggagaggca

SEQ ID NO: 616 - DNA, 8131 bp, Homo sapiens
atggaatgagaccaccacttctcctgttgtccttcccagcttctccccaacctccccttttccctagtttataagacaggagaaaagggagaaagcaaaaagctggaaagaaacagaagtaagataaatagctagacgaccttggcgccaccacctggccctggtggttaaaatgataataatattaacccctgaccaaaacgactggtgttatctgtaaatcccagacattgtgtgagaaagcaccgtaaaactttttgtcctattagctgatgtgtgtagcccccagtcacgttcctcacgcttacttgatctattatgaccctttcacgtggaccccttagagttgtaagctcttaaaagggctaggaatttctttttcggggagctcggctcttaagacgcgagtctgccgacgctcccggccgaataaaaacctcttccttctttaatccggtgtctgaggagttttgtctgggactcatcctgctacatttcttggttccctgaccgggaagcgaggtaattgacggacggtcgaggcggccccttaggcggcttaggcctgccctgtggagcatccctgcgggggactgtggccagcttgagctacgcagatcctgagagcactcccgggtaggcaatgctcttgacgggtggaacacctcgtcagagcagtgtgtggcaggcccccgtggaggatcagcacagtggctgaaggaacgggcacttggagcccggacatctgaaacttggtaagactggtctttggaacttgcccactccatttgagtggaagcatgtcctgatcacccacggtgtgcctgtaccggcactttggtttttgtttttgacttgacttgaattgcttgatactttggttttggttttgacctggcttggatttctggatactctgggtttggttttgattctggtttggtgtaaactgaaaaagtgtgtgtgtgccctttttacccattctttgttctgtggtgtgcgtgcggtgtgagcttggtgttttgtctcaaggaaacacgggtcagacacaaggtaagcctactccgctaggaactatgttgaaaaattttaagaagggatttaacggagactatggggttactatgacaccagggaaacagaattttgtgtgaaatagatcggccaacattagaagtgggttggccatcagaaggaagcctggacaggtcccttatttctaaggtatggcacaaggtaactggtaagtcaggacactcagaccagttcccatacatagacacttggttactacagctggtgcaagaccccccacagtggctaagagggcaggcagcagcagtgctagtagcaaagggacagatagccaaggaaggatcccgctctacccactgggggaaatcaactcctgaagttctgttcgacccaacatcagaagatccattgcaggagatggcaccagtgatcccagtgctgccctccccttaccaggcagagaggctccctacttttgagcccacagtgcttgtgcctccgtaagacaaacatatccctaggccacccagagtagacaagagaggaggtgaagcctcaggagaaacccctcccttggcagcttgtttaagacccaaaactgggatacaaatgcccctgagagagcagcggtatactgggatagaggaggatggtcacatggtggagaagcgtgtttttgtgtaccagcccttcacctctgccaaccttctcaattggaaaaacaataccctgtcctatactgaaaaaccacaagctctaattgatttgctccaaactattatccagacccataactccacttgagctgattgccaccagttgctcatgttcctctttaacacagatgaaaggcagagagtgctccaagcagcaactaagtgggtacaggaacatgcaccggctgattaccaaaacccccaagagtgtgtaaggacccagttaccaggaactgacccccagtgggatccaaatgaaagagaggatatgcaaaggctaaaccgagacagggaagctgtcttggaaggattaaagaggggagcccagaaggccacaaacgttaacaaggtctctgaggtcattcggggaaaaagaagaaagtccagcacaattctaccagagactgtgtgagggctatcgtatgtatactccctttgatcccgttagccctgaaaatcagcgaatggttaacatggctttagttagtcaaagcgcagaagacattagaagaaaactgcagaaacaggatgggtttgcagggacgaacacatcacagttattagaagtagctaaccaggtgtttgtaaacagggatgcagtaagccctaaggaaaaccgcagagagaatgaacgtcaggcccggcgaaacgccgagctgttagctgcagcagtcggaggggtctcctcaaagaggcaagggaaggggggacccgggaaagagactcagcctggctgtcagagcttgcagtgtaaccagtgtgcttattgtaaagaaataggatattggaagaacaaatgcccccagctaaaaggaaaacaaggtgacttggagcaggaggttccagacaaggaggaaggggccctgctcaacctggcagaagagttattggactgagggggaccgggctcaagggcccccaaagagcctatggccaggatgacagtcgggggtaaagacattgattttcttgtagatactggtgctgaacattcagtagtaaccgccccggtcgcccccttctccaaaaagactattgacataatcagagccatgggaatttcagcaaaacaagctttctgcttgccccggacttgtactgtaggaggacgtaaagtgattcatcagtttttatatatgcctgactgtcccttgcccttgttgggaagggacttgctttgcaagctgagagccactatctcttttacagagcatggctctttgctgctaaagttacctggaacgggagtcattatgacccttacggtcccctgagaggaggaatggagacttttcttaactgagtcaggccaagagataagaccagctctggctaagcggtggccaagagtgtgggcggaagacaaccctccagggttggcagtcaaccaagcccccatacttatagaagttaagcctggggcccagccagttaggcaaaaacagtacccggtccccagagaagctcttgaaggtattcaggtccctctcaagtgcctaagaacctttggaatgatagttccttgtcagtctccatggaacactcccctcctgcctgttcccgagcctaagaccaaggactactggccgggacaggatttgcgcttggttaagcaggctacagtgactttacatccagcagtacctaacccgtacacattgctggggttgctgccagctgaggacagctgcttcacctgcttggacctgaaagatgctttctttagcatcagattcgcccctgagagccagaagctgtttgcctttcagtgggaagatccggagtcaggtgtcactactcagtacacttggacctggcttcctcaagggttcaagaactcccccaccatcttcggggaggagttggctcgagacctccagaagtgtcccaccagaaacctaggctgcgtgttgctccagtacgttgatgaccttttgctgggacaccccacggcagtcgggtgcgccaagggaacggatgctctactccggcatctggaggactgtgggtataaggtgtccaagaaaaaagctcagatctgccgaccgcaggtacgttacttgggatttactatccgacagggggagcgcagcctgggatcagaaagaaagcaggtcatttgcactctaccggagcctaagagcagaaagcaggtgagaaaattcttaggagctgcggggttttgcagactgtggatcccaaactttgcagtattagccaagcctttgtatgaggtcacaaagtagggggaccgggaacctttcgaatggggatcccaacaacagcaagcctttcgtgagttaaaggaaaaacttatgtcagccccagccctggggctacccaatctgacaaagccttttacattgtatgtgtcagagagagaaaagatggcagttagagttttaacccaaactgtggggccctggccgaggccagtggcctacctctctaaacaactagatggggtttctaaaggatggcccccatgtttgagggccttggcagcaactgccctgctagtacaagaagcagttaagctgactcttgggcaaaacctgaacataaaggccccccatgctatggtgactttaataaatactaaaggacatcattggctaacaaatgctagactcaccaagtaccaaagtttgctctgtgaaaatccccgtataaccattgaaatttgtaacaccctgaaccccactaccttgcttctggtatcagagggccctgtcgagcatgactgtgtagaagtgttggactcagtctactctagcagacctgacctccaggaccagccttgggcaccagtagactgggaactatacatggatgggggcagcttcatcaacccacaaggagagagaggtgcagggtatgcagtggtaaccctggacactgttgttgaagccaggtcgttgccccaggccacttcacccagaaagctgaactcattgctttcattcgggccttagaactcagtgaaggtgagactgtaaacatttacactgactctcggtatccctttttaacccttcaagtgcatgaagcatcatataaagaaaagggcctattgaactctgggggaaaggacataaaatatcaacaagaaatcttgcaattattagaagccgtatggaaaccccacaaggtggcagttatgcattgcagaggacaccagcgagcttccaccttggtgggcttggggaattcccgtgctgactcagagttccggaaaggtagagcagatgaattggactatcaaaaatagttaagggaaagtatgtcaggaaacaggattaaaatggatacaggctctccctatggtattatttaaaattagatgtaccccttctaaaagaacaggatattccccttatgaaatattataggccccctcccatattgcggggacttccaggcactccccgagagttaggtgaaattgagttacagcgacagctacaggctttaggaaaaattacacaaacaatctcagcctgggtaaatgagagatgccctgttagcttattctccccagttcaccctttctccccaaggactggaacgtagcctctttgtgcccacggtggaaaggaccccagactgtcatcctgaccactcccaccgctgtgaaggtagaaggagtcccagcctggatccaccacagccgtgtaaaacctgcagtgcctgaaacctcagaggtaagaccaagcccagaggacccttgcagagtgaccctgaagaaaacgacaagccctgctccagtcacgcccggaagctgactggtccacgcacggccaaagcatgaggaagctcatcgtgggattcatttttcttacattttggacttacacagtaagggcttcaactgaccttactcaaagtggggactgttcccagtgtattcaccaggtcactgacgtaggacagcaaattaaaacaatctttctgttctatagttattatgaatgtatgggcacgttaaaagaaacttgattgtataatgcaactcagtacaaggtatgtagcccgggaaatgaccaacctgatgtgtgttataacccatctgagccccctgtaaccactgtttttgacagaagattaagaactggccttttcccaggtgatacaagtaaaataataactagaacagaagaaaaaggaatccccaaacaagtaactttaagatttgatgcttatgcagccattaatagtaacaagctaggaacaggatgtggttctcttaactgggaaaggagctacagagtagaaaataaatatgtttgtcatgagtcaggggtttgtgaaaattgtgccttttggccatgtgttatttgggctacttggaaaaagaacaaaaaggacctggttcatcttcagaagggggacgccaacccctcctgtgctgccggtcactgtaacccactagaactaataattaccaatcccctagatccccgttggaaaaagggagaacgtgtaaccctggggatcgatgggacagggataaacccccaagttgccattttagttagaggggaggtccacaagcactctcccaaaccagtgtttcaaaccttttatgaggagctgaatctgccagcaccagaacttccgaaaaagacaaaaaatttgtttctccaattagcagaaaatgtagctctttcccttaatgttacttcctgttatgtatgcaggggaaccactatcggagaccgatggccttgggaagcccgagagttggtgcctactgatccagctcctgatataattccagttcagaaggcccaagctagcaacttctgggtcctaaaatcctaattattggacaatactgtatagctagagaagggaaagactttatcgtccctgtagaaaagcttaattgtataggacagaagttgtacaacagcacaacaaagacaattacttggtggggcctaaaccacactgaaaagaacccatttagtaaattttctaaattaaaaactgcctgggctcatccagaatctcatcaggactggacggctcccaccggactataccggatatgtgggcacacagcctacattcagttacctaataaatgggcaggcagttgtgttattggcactattaagctgtcctttttcttattacccataaaaacgggtgagctcctaggtttccgtgtctatacctcccgagaaaagagaggcatagttataggaaactggaaagataatgagtggccccctgaaaggatcatacaatattatgggcctgccacatgggtacaagacggctcatggggataccaaacccccatctacatgctcaatcagatcatacggttgcagaccgtcttagaaataattactaatgaaactggcagagctttgactgttttagctcggcaggaaacccaaatgaggaatgctatctatcagaatagactggccttggactacttgctggcagctgaaggaggagtttgtggaaaatttaacttaaccaattgctgcctacaaatagatgatcaaggacaggtgattgaaaacatagtcagggacatgacaaagttggcacacacgcctatacaggtttggcacaagtttgatcctgagtctttatttggaaaatggtttccagctataggaggatttaaaaccctcattgtaggtgtattgctagtaataagaacttgcttgctgctcccctgtgtattacccttgctttttcaaatgataaaaggtattgttgctactttggttcatcagaaaacttcagcacacgtgaattatatgaatcactatcgctctatctcgcaaagagactcaaaaagtgaggatgagagtgagaactcccactaaaaagtgaaaattctcaaaggggggaaatagggaatgagaccaccacttctcctgttgtccttcccagcttctccccaacctccccttttccctagtttataagacgggagaaaagggagaaagcaaaaagctggaaagaaacagaagtaagataaatagctagacgaccttggcgccaccacctggccctggtggttagaatgataataataatattaacccctgaccaaaacgactggtgttatccgtaaattccagacattgtgtgagaaagcaccgtaaaactttttgtcctgttagctgatgtgtgtagcccccagtcacgttcctcacgcttacttgatctattatgaccctttcacgtggaccccttagagttgtaagctcttaaaagggctaggagtttctttctcggggagctcggctcttaagacgcgagtctgctgacgctcccggccgaataaaaacctcttccttctttaatctggtgtctgaggagttttgtctgcgactcatcctgctaca

SEQ ID NO: 617 - DNA, 1018 bp, Homo sapiens
ccaaaaaaaaaggactgtaggaaaaagaaagagagatcagactgttactgtgtctatgtagaaagaagtagacacaagaaactccattttgttctgtactaagagaaattcttctgccttgagatgctgttaaactgtaaccctagccccaaccctgtgcttgcagagacatgagctgtgttgactcaaggtttaatggatttagggctgtgcagggtgtgctttgttaaaaaagtgcttgaaggcagtaggcttgataaaagtcatcgccattctccaatctcgagtacccagggacacaatacactgcggaaggccgcagggacctctgcccaggaaagccaggtattgtccaaggtttctccccatgtgatagcctgagatatggcctcgtgggaagggaaagacctgactgtctcccagcctgtcccccagcccgacgcccataaagggtctgtgctgaggagggttagtgaaagaggaaggcctctttgcagttgagataagaggaaggcatctgtctcctgctcgtccctgggaatggaatgtcttgggtgtaaaaccagattgtgtgttctatttactgagataggcgaaaaccgcctcagggctggaggtgggacctgctggagacaatactgctctttgatgcacgagatgttgtgtaggtgcacatcaaagcacagcacccttccttaaacttatttatgacacagagacctttgctcacatattttcctgctgaccctctccccattaccctatcgtcctgccacatccccctctccgagatggtagagatagtgatcaataaatactgagggaactcaagagaccagtgcctgcgcagcgcaggtcctccgtatgcgcaggtcctccgtatgcgggatgctgagcgtatgctgagcaccggtcccaggggaccactgttctttctctatactttgtctctgtgtcttatttcttttctcagtctctcgtcccacctgacgagaaacgcccacaggtgtggaggggc

SEQ ID NO: 618 - DNA, 497 bp, Homo sapiens
taagatctcaggagttggatgagtgggctcaagcatgtgcacaaagagacaaaatggcagagtttaatgggtatatgaccttcctctaggaacattcaactggttaagggaaaaacacctcaagtgagcatgtatacaactctagtaaacacactgtgtatgtggcccctcccaggtgctggcaggccactgtgcatacagacagcccactccaagggaagaatcaggggagaagcagcacaacacccctgaagcatgccaacgtataaaaccccaagtgaaaaagtcaaacggtgcacttgatctctcaagtcacctgcttggccctcttccaagtatactgtacttcttttcattcctgccctaaaacttctcaataaactttcactcctgctctaaaacatgctttagtctctccttctgcctatacccctccactgaattctttcttctgaggaggtaagaactgaggttgctggagacctgtatggatttgc

SEQ ID NO: 619 - DNA, 56 bp, Homo sapiens
cctccactacgccccctcagcaggaagaagccagagtgatcgacggccttttccca

SEQ ID NO: 620 - DNA, 639 bp, Homo sapiens
gtcaggcctgagcccaagctaagccatcatatcccctgtgacctgcatgtatacatccagatagcctgaagcaaccgaagatccacaaaagcagtgaaaatagcctgttcctgccttaactgatgacattccaccattgtgatttgttcctgccccaccctaactgatcaattgactttgtaacaatacaccctaccccccttgccataatgtactttgtgatattctctgcccccccattccccccccgcaccccccccacccccgcgaatgtactttgtacaatacaccctccccacccttgaggaggtactttgtaatatcctgccctgcctttaagaaggtactttgtaatattcttcccccaacccccccccctccggccgccccatccccccttaagaagatactttgtaatattccccccacccttgagaatgtactttgtgagatccacccctgcccgcaaaacattgctcctaactccacggcttatcccaaacctataagaactaatgataatcccaccaccctttgctgactctcttttcggacacagccccctgcaccctggtgactaaaaagctttattgctcacacaaagcctgtttggtggtctcttcacacagacgcacgtga

SEQ ID NO: 621 - DNA, 4093 bp, Homo sapiens
tgactctcttcggactcagcccgcctgcacccaggtgaaataaacagccatgttgctcacacaaagcctgtttggtggtctcttcacacggacgcgtatgaaatttggtgccgtgactcggatcgggggacctcccttgggagatctatcccccgtcctcctgctctttgctccatgagaaagatccacctacgacctcaggtcctcagaccaaccagcccaggaaacatctcaccaatttcaaatccggtaagcggcctctttttactctcttctccaacctccctcactatccctcaaccccttctccttcaccctcagcggcaagtcccgctttcctgggacaggggcaagtacccctcaaccccttctccttcaccctcagcggcaagtcctgctttcctggggcaggggcaagtacccctcaaccccttctccttcaccctcagcagcaagtcccgctttcctagggggcaagaaccccccaatcacttatttctgcaccccaacctcttatctctgcgccccaatcccttatttccgcaccctgacctcttatttccgtgccccaaccccttctctgcttttctggagggcaagaaccccccaccccttctccgtgtctctactcttttctctgggcttgcctccttcactatgggtaagcttccaccttccattcctccctcttctcccttagcctgtgttctcaaaaacctaaaacctcttcaactaacacctgacctaaaacctaaatgccttattttcttctacaatgctgcttgaccccaatacaaattcgacagtagttccaaatagccggaaaacggcactttcaatttttccatcctacaagatctaaataattattgtcgtaaaatgggcaaatggtctgaggtgcctgacgtccaggcattcttttacacatcagtcccttcctagtctctgtgcccagtgcaactcgtcccaaatcttccttctttccctcccgcctgtcccctcagtcccaaccccaagcgtcgctgagtctttctaatcttccttttctacagacccatctgacctctcccctcctcaccagcccaagctaggtcccaattcttcctcagcctccactcctccaccctataatccttctatcacctcccctcctcacacctggtctggcttacagtttcgttctgtgactagccctcccccacctgcccagcaatttattcttaaaaaggtggctggagctaaaggcatagtcaaggttaatgctcctttttctttatcccaaatcagacagcgtttaggctttttcatcaaatataaaaacccagcccagttcatggctcgttcagcagcaaccctgagacgctttacagccctagaccctaaaaggtcaaaaggccatcttattctcaatatacattttattacccaatctgctcccgacattaaataaaactccaaaaattaaattccagccctcaaaccccacaacaggatttaattaacctcgccttcaaggtgtacaataatagaaaaaagttgcaattccttgcctccactgtgagacaaaccccagccacatctccagcacacaagaacttccaaacgcctgaaccgcagtggccaggcgttcctccagaacctcctcccacagaagcttgctacaagtgccagaaatctgaccaccaggccaaggaatgcctgcagcccaggattcctcctaagccgtgtcccatctgtgcgggaccccactggaaattggactgttcaactcacctggcagccactcccagagcccctggaactctggcccaaggctctctgactgactccttctcggcttagcagctgaagactgatgctccccgattgcctcggaagccctgtagaccatcatggacgccaagctttgggtaactctcacagtggaaggtaagtccgtccccttcttaatcaatacggaggctacccactccacattaccttcttttcaagggcctgtttcccttgcctccataactgttgtgggtattgacagccaggcttctaaacctcttaaaactccccaactctggtgccaacttagacaatactcttttaagcactcctttttagttatccccacctgcccagttcccttattaggctgagacactttaactaaattatctgcttccctgactattcctggactacagctgtatctcattgccgcccttcttcccaatccaaagcctcctttgcatcctcctcttatatccccccaccctaacccacaagtataagatacctctactccctccttggcgaccgatcatgcaccccttaccatctcattaaaacctaatcacccttaccccactcaacgccaatatcccatcccgcagcatgctttcaaaggattaaagcctgttatcacgcgcctgctacagcatggccttttaaagcctataaactctccttaccattcccccattttacctgtcctaaaaccagacaaggcttacaggttagttcaggatctgcgccttatcaaccaaattgttttgcctttccaccctgtggtgccaaacccatatgctctcctatcctcaatacctccctctactacccattattctgttctagatctcaaacatgctttctttactattcctttgcacccctcgtcccagcctctctttgctttcacttagactgaccctgacatccattaggctcagcaaattaccaaggctgtactgccgcaaagcttcacagacagcccccattacttcaatcaagcccaaatttcttcctcatctgttacctatctcggcataattctcataaaaacacacgtgctctccctgccaatagtgtccgactgatctctcaaaccccagcaccttctacaaaacaacaactcctctccttcttaggcatggttagcgtggtcggaattcttacacaagagccaggaccacatcctgtagcctttctgtccaaacaacttgaccttactgttttagcctagccctcatgtctgcgtgcagcggctactgctgctttaatacttttagaggccctcaaaatcacaaactttatcagtcctccaggcccaagttgactctttagctgcagttgtcctccaaaaccgccgaggccttgacttactgctgaaaaaggaggactctgcatattcttaaatgaggagtgttgtttttacctaaatcagtctggcctggtgtatgacaacataaaaaaactcaaggatagagcccaaaaacttgccaaccaagaaagtaattacgctgaacccccttgggcactctctaactggatgtcctgggccctcccaattcttagtcctttaatacccatttttctcctccttttattcggaccttgtatcttccgtttagcttctcaattcatccaaaaccgtatccaggtcatcaccaatcattttatacgacaaatgtttcttctaacatccccacaatatcaccccttaccacaagacctcccttcagcttaatctctcccactctaggttcccacgccgcccctaatcccacttgaagcagctctgagaaacatcgcccattctctctccataccaccccccaaaaattttcgccactccaacacttcaacactattttgttttgtcttattaatataagaaggcaggaatgtcaggcctctgagcccaggcaaggccatcgcatcccctgtgacttgcacgtatacatccagatagcctgaagtaactgaagatccacaaaagaagtaaaaacagccttaactgatgacattccaccattgtgatttgttccttccccaccctaactgatcaatgtactttgtaatctcccccacccttaagaaggtactttgtagtctcccccacccttaagaaggttctttgtaattctccccacccttgagaatgtactttgtgagatccacccctgcccctttgactgtaactttccattaccttcccaaatcctataaaacggccccacccctatctcccttcgctgactctcttttcggactcagcccacctgcacccaggtgaaataaacagctttattgctcacaaaaa

SEQ ID NO: 622 - DNA, 3865 bp, Homo sapiens
gtcaggcctctgagcccaagccaagccatcgcatcccctgtgacctgcacgtatacacccagatggcctgaagtaactgaagaatcacaaaagaagtgaatatgccctgccccaccttaactgattacattccaccacaaaagaagtgtaaatggccggtccttgccttaactgatgacattaccttgtgaaagtccttctcccggctcatcctggcccaaaatcacccccactgagcaccttgcgacccccactcctgcctgccagagaacaaatcccctttgactgtaattttcctttacctacccaaatcctataaaatggctccacccttatctcccttcgctgactctcttttctgactcaacccacctgcacacaggtgattaaaagctttattgctcacacaaagcctgtttggtggtctcttcacatggacacgcatgaaatttggtgccatgactcggatcgggggacctcccttgggagctcaatcccctgtcctcctgttctttgctccgtgagaaagatccacctatgacctcaggtcctcagaccagccagcctaaggaacatctcaccgattttaaatcaggtaagcggcctcttcttactctcttctccaacctctctcactgtccctcaaccactttctcctttccactcttcaatctctcccttctcttaatttcaattcctttcattttctgggagagacaaaggagacacattttatccatggacccaaaactccggtgccggtcacggactgggaaggcagccttcccttggtgtttaatcattgcagggacacctctctgattatacacccatgtttcaaggatgtcagaccacgcagggacgcctgccttggtccttcacccttagcggcaagtcccgcttttctggagaagggtcaagtaccccaaccccttctgtccttgtctctaccccttctctgcttttctggggacagggcaagtaccccaaccccttctctccttgtctctaccccttctctgcttttctgggagaggggcaagtacccctcaaccccttctccttcacccttagtggcaagtcctgcttttctactgggcaagaatccccaatcccttatttctgtgccccaacctcttatctctgtgccccaatctcttatttccgtgcaacaacctcttatctctgtgccccaatcccttatttccgtgcaacaacctcttatatctctgcacctcaatcccttatttccacaccccgacctcttatctctgtgccccaatcccttatttccatgccctgaccccttatttctgtgccccatcccttatttccctgccccgacctcttatctctgcgccccaaccccttttcccacttttctggaaggtaagaacctccgaaccccttccctccatttctctactctctcttttctctaggcttgcttccttcactatgggcaaccttccaccctccattcctccttctactcccttggcctgtgtgctcaaaaacttaaaacctcttcaactcacacctgacctgaaacctaaatgccttattttcttctgcaatgccgcttgaccccaatacaaatttgacagtagttccaaatagccagaaaatggcactttgaatttttccatcctgcaagatctaaatatttcttgtcgtaaaataggcaaacggtctgaggtgcctgatgtccaggcattcttttacacatcagtcccttcctagtctctgtgcccagtgcaacttgtcccaaatcttccttctttccctcccgcctgtcccctcagtaccaaccccaagcgtccctgagtctttctaatcttccttttctacagacccatctgacctctcccttcctccccaggctgctcctcgccaggccgagccaggtcccaattcttcctcagcctctgctcctccaccctgtaatccttttatcacctcccctcctcacacctggtccagctttcagtttcattctgccacttgccctcccgcacctgcccagcaatttacccttaaaaaggtggctggagccaaaggcgtagtcaaggttaaagctcctttttctttatcctaaatcagaagcatttaggctctttttcatcaaatataaaaatccagccccattcatggctcgttcggcagcaaccctgagacactttacagccctagaccctaaaaggtcaaaaggccgtcttattctcaaaatacattttattacccaatctgctcccgacattaaataaaactccaaaaattaaattccggccctcaaaccccacaacaggatttaattaacattgccttcaaggcgtacaataatataaaaaagttgcaattccttgcctccactgtgagacaaaccccagccacatctccagcacacaagaacttccaaacgcctgaaccgcagcagccaggcgttcctccagaacctccttccccaggagcttgctacacgtgccggaaatctggccactgggccaaggaatgtccgcagcccaggattcctcctaaaccgcgtcccatctgtgcgggaccccactgaaaatcggactgttcaactcacctggcagccactcccagagcccctggaactctggcccaaggctctctgactgactccttcccagatcttcttggcttagcggctgaagactgacactgcccgatcacctcggaagccccctcgaccatcacggacgccgagcttcaggtaactctcacagtggaaggtaagcccgtccccttcttaatcaatatggaggctacccactccacattaccttcttttcaagggcctgtttcccttgcctccataactgttgtgggtattgacggccaggcttctaaacctcttaaaactccccaactctggcgccagcttagacaatgctcttttaagcactcctttttagttatccccacctgcccagttctcttattaggccaagacacttcaactaaattatctgcttccctgactattcctggactacagctacatctcattgccgcccctcctcccaatccaaagcctcctttgcgtcctcctcttgtatccccccaccttaacccacaagtatacctctactccctccttggtgaccgatcatgcaccccttaccatctcattaaaacctaatcacccttaccccactcaacgccaatattcccatcccgcagcatgctttaaaaagattaaagcctgttatcactcgcctgctacagcatgaccttttaaagcctataaactatccttacaattcccccattttacctgtcctaaagccagacaagccttacaagttagttcaggatctatgccttatcaaccaaattgtttcgcctatccaccctgtggtgccaaacccctacactcttgtcctcaataccctcctccacaactcactgttccgtgcttgatcttaaagatgcttttttcactattcccctgcacccctcgtcccagcctctcttcgccttcacttagactgaccctgacacccattaggctcagcaaattaccaaggctgtactgccgcaaggcttcatagacagcccccattacttcagtcaagcccaaatttcatcctcatctgttacctatctcggcataattctcataaaaacatacgtgctttccctgctgatcgtgtccgattaatctcccaaacctcaatcccttacaaaacaataactcctttccttcctaggcatatagttagtgcgatcagaattcttatgcaacagccaggactgcaccctgtagcctttctgtgcaaacaacttgaccttactgttttagcctagccctgatgtctgcatgcagcggctgccgctg

SEQ ID NO: 623 - DNA, 87 bp, Homo sapiens
aaaaggacttgtatttatagccagacgacctactcagttactcaatttgtgaccaggaaataaccaaccttatgtatgttataaccc

SEQ ID NO: 624 - DNA, 59 bp, Homo sapiens
acaaccaaaaaaagaggactctgcatcttcttaggggaagagtgttgtttttacactaa

SEQ ID NO: 625 - DNA, 717 bp, Homo sapiens
ttaagtaggtagctagtcaggcatgagcagggcaggagagggctccccctgctccattgccccccaccaacaccagaaatgttaggcgaccatcaggtgatggtcaggtggttgttaaactctctgtctaaaataataattggtcacagtcagcgctagggaaaggcagtctctcaatagatagaaacacctgaagctggtgatgagcagcttcctgatgaggtctcaggagctgggtgagtgggctcaaacatgtgcactaaggggcaaaatggatggagtttaactggtatatgaccttcctgcaggaatgctagactggcgggggaggaatgcctcaagtgagcatgcgtacaactccagtaatcacactgcacacactcccctcctaagtgctaactgaccactgtgcatgcagacagtccaccccaagggaagaatcaggggagaaacaatgcaagaccctggaagcaagacagtgtataaaaccccaagtccaaagaccaaaccacgcacctgatctctcaagtctcccactcagccctcttccaagtgtactttacttcctttcattcctgctctaaagctttttcataaactttcccttctgctggaaaacttgccttggtctctccttctgccttatgcccctcggctaaattctttcttctgaggaggcaagaactgaggttgctgcaggcccatacagattcgcca

SEQ ID NO: 626 - DNA, 431 bp, Homo sapiens
gtcaggcctctgagcccaggctaagccatcatatcgcctgtgacctgcacgtatacatccagacagcctgaagcaagtgaagaatcacaaaagaagtgaaaatggccggttcctggcttaactgatgacattccaccactgtgatttgttcctgccccaccttaactgagcaattaaccttgtgaaattccttctcctggctcagaacctcccccactgagcaccttgtgaccgctgtccctgcctgtaagagaaaaaccccctttgactgtgattttccactacctacacaaatcctataaaacgtccccacccctgtctcccttcactgactctctttttggactcagcccgcctgcacccagttgactaaaaagccttattgctcacacaaagcctgtttggtggtctcttcacacagacgcacgtga

SEQ ID NO: 627 - DNA, 440 bp, Homo sapiens
ccaggccatcgcatcccaggccaggccatcgcatcccctgtgacttgcaggtatacatccagatggcctaaagtaactgaagatccacaaaagaagtaaaaacagccttaactgatgacattccaccattgtgatttgttcctgccccaccctaactgatcaatgtactttgtaatcttccccacccttaagaaggttatttgtaattctccccacccttgagaatgtactttgtgagattcacccctgcccaccagagaacaaccccctttgactgtaattttccattaccttcccaaatcctataaaacggccccacccctatctcccttcgctgactctcttttcggactcagcccgcctgcacccaggtgaaatacacagccatgttgctcacacaaagcctgtttggtggtctcttcacatggacgcacatgaaa

SEQ ID NO: 628 - DNA, 4861 bp, Homo sapiens
gtcaggcctctgagcccaagccaagccatcgcatcccctgtgacttgcacggatatgcccagatgacctcttaaatctctgcaccccaatcccttatttctgtgccctgacctcttatctctgcaccccaatcccttatttctgcaccccgacctcttatctctgtgccccaatcccttatttccgcaccctgacctcttatctctctgccccaatcccgtatttccatgccccaacctcgtatctctgcaccccaatcccttatttccgcaccccaccctcttatatctctgcacctcaatcccttatttccatgccctgacctcttatctctgtgccccaaccccttttctggaagataagaacccccgaaccccttccgtttctctactctctcttctctctaggcttgcttccttcactataggcaaccttccaccctccattcctccttctactgccttggcctgtgttctcaaaaacttaaaacctcttcaactcacacctgacctaaaacctaaatgccttattttcttctgcaatgccacttgaccccaagacaaactcgacagtagttccaaatagccagaaaatagcactttgaatttttccatcctacaagatctaaataattcttgtcgtaaaataggcaaatggtctgaggtgcctgaatgtccaggcattcttttacacatcagtcccttcctagtctctgtgcccagtgcaacttgtcccgaatcttcctcctttccctcccgcctgtcccctcagtcccaaccccaagcgtcgctgagtctttctaatcttccttttctacagacccatctgacctctcccttcctccccaggctactcctcgccaggccgagctaggtcccaattcttcctcagcctctgctcctccaccctataatctttttatcacctcccctcctcacacctggtccggcttagtttcattctgtgactagccctccccgtcctgctcagcaatttactctttaaaaggtggctggagttaaaggcatagtcaaggttaatgctcctttttctttatcccaaatcagatagcgtttaggctctttttcatcaaatataaaaatccagcccagttcatgacttgtttggcagcaaccctgacacgctttacagccctagaccctaaaagggcaaaaggccgtttcattctcaaaatacattttattacccaatctgctcccaacattaaataaaactccaaaaattaaattccagccctcaaacaccacaacaggatttaattaacctcatcttcaaggttacaataatagaaaaaagttgcaactccttgcctccactgtgagacaaacctgagccacatctccagcacacaagaacttccaaacgcctgaaccgcagcagccaggtgttcctccagaacctcctcccacaggagcttgctacacgtgctggaaatctggccaccaggacaaggaatgcccacaatccaggattcctcctaagctgcatcccatctgtgtgggaccccactgaaaatcggactgttcaactcacctggcagccactcccagagcccctggaactctggcccaaggctctctgactgactccttcccagatcttctgggcttagcggctgaagactgactgcccgatcccctcggaagccccctagaccctcacggacgccgagcttcgggtaactctcacagtggaaggtaagtccatccccttcttaatcaatacagaggctacccactccacattaccttcttttcaagggcctgtttcccttgcctccataactgttgtgggtattgacggccagacttctaaacctcttaaaactccccaactctggtgccaacttagacaatactcttttaagcactcctttttagttatccccacctgcccagttcccttattaggctgagacactttaactaaattatctgcttccctgactattcctggactacagctacatctcattgctgcccttcttcccaatccaaagcctcctttgcgtcctcctcttgtatccccccaccttaactcacaagtataagatacctctactccctccttggcgaccgatcatgcacccgttaccatctcattaaaacctaatcacccttacccaactcaacgccaatatcccatcccgcagcacgctttaaaaagattaaagcctgttatcactcgcctgctacagcatggccttttaaagcctataaactctccttacaattcccccattttacctgtcctaaaaccagacaagccttacaagttagttcaggatctgcgccttatcaaccatattgttttgcctatccaccccgtggtgccaaacccatatactctcctatcctcagtacctccctctacaacccattattgagatctctcacttggactgaccctgacacccatcaagctcagcaaattacctaggctgtactgccgcaaagcttcacagacagcccccattacttcaatcaagcccaaatttcatcctcatctgttacctatctcggcataattctcataaaaacacatgtgctctccctgccaattgtgttggactgatctctcaaacccaagcaccttctacaaaacaacaactcttttccttcctaggcatggttagtgcggtcagaattcttacacaagagccaggaccgcaccctgtagcctttctgtccaaacaacttgaccttactgttttagcctagccctcatgtctgtgtgcagcagctgccgctgctttaatacttttagaggccctaaaaatcacaaactatgctcaactcactctctacagttctcataacttccaaaacctattttcttcctcatacctgacccatatactttctgcttcccggctccttcagctgtactcactctttgttgagtctcccacaattaccgttgttcctggcccagacttcaatccggcctctcacattattctggataccacacctgacccccatgactgtatctctctgatccacctgacattcaccccatttccccaaatttccttctttcctgttcctcaccctgatcacggttgatttattgatggcggttccaccaggcctaatcgccacacaccagcaaaggcaggctatgctatagtacaagccactagcccgcctctcagaacctctcatttcctttccattgtggaaatctatcctcaaggaaataacttctcagtgttccatctgctattctactactcctcagggattattcaggccccctcccttccctacacatcaagctcgaggatttgctcccacccaggactggaaaattagctttactcaacatgccccaagtcagataactaaaatacttcttagtctaggtagacactttcgctggataggtagaggcctttcctacagggtctgagaaggccaccgcagtcatttcttccattctgtcagacataattcctcagtttagccttcccacctcaatacagtctgataacagaccagcctttattagtcaaatcagccagcagtttttcaggctcttagtattcagtgaaacctttatatcccttacggtcctctgtcgtcaagaaaagtagaatagactaaaggtcttttaaaaaacacacctcaccaagctcagccaccaacttaaaaaggactggacaatacttttaccactttcccttctcagaattcaggcctgtcctcggaatgctacaggatacagcccatttaagctcctgtatagacgctcctttttattaggccccagtctcattccagacaccagaccaacttagactgtgcccaaaaaacttgtcatgcctactatcttctgtctagtcatactcctattcaccattctcaactactcatacatgccctgctcttgtttacactgccagtttacactttttccaagccatcacagctgatatctcctggtgctgtccccaaactgccactcttaactcttgtagtaaataaataatctttgctggtaggactatgctgaatctccttaggcactctctaatcagatatcctgagtcgtcccaattcttagaccttttatacctgtttatctccttctgttattccatttagtttctcaattcatccaaaacagtatctaggccatcaccaatcattctacacgacaaatgtttcttctaacaaccccacaatatcaccccttaccacaagacctcccttcagcttaatctctcccactctaggttcccacgccgcccctaatcctgcttgaagcagccctgagaaacatcgcccattctctctccataccttccccccaaaattttcgccaccccaacacttcaacactattttgttttatttttcttattaatataagaagtcaggaatgtcaggcctctgagcccaagccaagccatcgcatcccctgtgacttgcacgtataagcccagatggcctgaagtaactgaagaatcacaaaagaagtgaatatgccctgccccaccttaactgatgacattccaccacaaaagaagtgtagatggaaggtccttgccttaagtgatgacattaccttgtgaaagtccttttcctagctcatcctggctcagaaagcacccccgctgagcaccttgtgacccccactcctgcctgccagagaacaaaacccctttgactgtaattttcctttacctacccaaatcctataaaacggccccacccttatctgccttccctgactctcttttcggactcagcccacctgcacccaggtgaaataaacagccatgttgctcacacaaagcctgtttggtggtctcttcacacggacgcacatgaaa

SEQ ID NO: 629 - DNA, 372 bp, Homo sapiens
gtcaggcctctgagcccaagcctgcatgtatacatccagatggcctgaggcaacagaagaaccacaaaagaagtgaaaatggccggttcctgccttaactgatgacattaccttgtgaaattccttctcctgcacaatgagtctcagaagctcccccactgagcaccttgtgactcccgccccagccagagaataaccccctttaactgtgatttttccactacctatccaaatcctataaaactgacccacccctatttccctttgctgactctcttttcagactcagcccacttgcacccaagtgaaataaacagccttgttgctcacacaaagcctgttggtggactctctctgcacagacgtgtgtga

SEQ ID NO: 630 - DNA, 5808 bp, Homo sapiens
tcaggcctctgagcccaagccaagccatcgcatcccctgtgacttgcacgtatatgcctagatggcctgaagtaactgaagaatcacaaaagaagtgaatatgccctgccccgccttaactgatgacattccaccacaaaagaagtgaaaaaggccggtccttgacttaactgatgacattatcttatgaaattccttctcctggctcatcctggctcaaaaagctcccccactgagcacgttgccacccccactcctgcccgccagagaacaaaccccctttttcctttacctacccaaatcttataaaacggcctcacgcctatctcccttcactgactcccttttcggactcagcccacctgcgcccaggtgaaataaacagccttgttgctcacacaaagcctgtttggtggtctcttcacatggacgtgcattaaatttggtgccgtaactggcgcggggggaggggggggggaacctcccttgggagatcaatcccctgtcctcctgctctttggtccatgagaaagatccacctacaacctcaagtcctcagaccaaccagcccaagaaacatctcaccaatttcaaatccagtaagcagcctctttttactctcttctccaacctccctcactatccctcaacctctttctcctttcaatcttggcgccacacttcaatttctcccttctcttaacttcaattcctttcattttctggtagagataaaggagacacgttttatccgtggacccaaaactccagcgccggtcacggactgggaaggcagccttcccttggtgtttaatcattgcagggacacctctctgattattcacccaggtttcagaggtgtcagaccacgcagggacgcctgccttggtccttcacccttagcggcaagtcccgcttttctggggaatgggcaaggaccccaaccccttctctccgtgtctctaccccttctccgcctttctggggggcaagaaacccccaaccccttctccttcaccctgagcggcaagtcccgcttttctagaggaggagcaagtactccaacctcatatctctgcgccccaatcccttatttctgtgccccaacctcttatctctgtgccccaatcccttatttccatgcccccacctcttatatctctgcaccttgatcccttatttccacatcccgacctcgtatctctgcaccccgacccctttcccacttttctggagagtaagaacccctgaaccgcttctctccgtgtctctactctcccttttctttaaacttgcctccttcactgtaggcaaccttccactctccattcctccttcttctcccttagcctatgttctcaaaaacttaaaacctcttcaactcacacctgacctaaaacctaaatgccttattttcttctgcaatgccgcttgaccccaatacaaactcaacagtagttccaaatagccggaaaacagcactttcaatttttccatcctgcaagatctaaataattcttgtcgtaaaatgggcaaatggtctgaggtgcctgacgtccaggcgttcttttacacatcagtccctccctagtctctgttcccagtgcaactcatcccaaatcttccttctttccctcccgcctgtctcctcagtcccaaccccaagcatcgctgagtctttctaatcttttctatagacccatctgacctctcccctcctccccaggctgctccttgccaggccgagctaggtcccaattcttcctcagcctccgctcctccaccatataatctttttatcacctcccctcctcacacccggtccggcttacagtttccttccgtgactagccctcccctacctgcccagcaattttctcttaaaaaggtggctggagctaaaggcatagtcaaggttaatgctcctttttctttatcccaaatcagatagcgtttaggctctttttcatcaaatataaaaacccagcccagttcatgcctcgtttggcagcaaccctgagacactttacggccctagaccctaaaagcccaaaaggccgtcttattctcaatatatattttatcacccaatctgctccctacattaaataaaactccaaaaattaaattccggccctcaaaccccacaacaggatttaattaaccttgccttcaaggtgtacaataatagaaaaaagttgcaattccttgcctccactgtgagacaaaccccagccacatctccagcacacaagaacttccaaacacctgaactgcagcggccaggcattcctccagaacctcctcccccaggagcttgctacaagtgccagaaatctggccaccaggccaaggaatgcctgcagcccaggattcctcctaagccgtgtcccatctgtgcgggaccccactggaaatcggactgtccaactcacctggcagccactcccagagcccctggaactccggcccaaggctctctgactgactccttcccagatcttcttggcttagcggctgaagactgacactgcccgatcacctcggaagccccctagaccatcacggacgccgagctgccagtaactctcacagtggaaggtaaacccgtccccttcttaatcaatacggaggctacccactccacattaccttcttttcaagggcctgtttcccttacctccataactgttgtgcgtattgacagccaggcttctaaacctcttaaaactccccaactctggtgccaacttagacaatactcttttaagcactccttttagttatccccagctgcccagttcccttattaggctgagacactttaactaaattatctgcttccctgactattcctgggctacagccacacctcattactgcccttcttcccaatccaaagcctcctttgtgtcctcctcttgtatcccccgaccttaacccataagtataagatacctctactccctccttggtgaccgatcatgcaccccttaccatctcatcgaaacctaatcacccttaccccgctcaacaccaatatcccatcccacagcatgctttgaaaagactaaagcctgttatcactctcctgctacagcatggccttttaaagcctataaactctccttacaattcccccatttcacttgtcctaaaaccagacaagccttacaagttagttcaggatctgtgccttatcaaccacattgttttgcctatccaccccatggtgtcaaacccatatactctcctatcctcaatacctcactccataatccattattgtgttctggatctcaaacatgctttctttactattcctttgcacccttcatcccagcctctcttcactttcacttggactgaccctgacacccatcaggctcagcaaattacctgggctgtactgccccaaagcttcacagacagcccccattacatcagtcaagcccaaattttttccctatctgttacctatctcagcataattctcataaagacacacgtgctctccctgccgatcatgtccgattaatctcccaaaccccaaccccttctacaaaacaagaactcctttccttcctaggcatggttagtgcagtcagaattcttacacaagagccaggaccgcaccctgtagaccttctgtccaaacaacttgaccttactgttttagcctagccctcatgtctctgtgcagcggctgctgccaccctaatacttttagaggccctcaaaatcacaaactatgctcaactcactctctacagttatcataacttccaaaatctattttcttcctcatacctgacatatatactttctgctccccggctccttcagctgtactcactctttattgagtctcccacaattaccatttttcctggcaccgacttcaatccagcctcccacattattcctgataccacacctgacccccatgactgcatctctctgatccacctgacgttcaccccatttccccacatttccttcttccctgcttctcaccctgatcacacttggtttatggatggcagttccaccaggcctaatggccacacaccagcaaaggcaggctgtgctatagtacaagccgctagcccgcctcttagaacctctcatttcctttccatcgtggaaatctatcctcaaggaaataacttctcagtgttccatctgctattctactgctcctcagggattattcaggccccctcccttccctacacatcaagctcagggatttgcctccacccaggactggcaaattgactttactcaacatgccccgagtcagataactaaaatacctcttattctaggtagacactttcactggataggtagaggcctttcctacagggtctgagaaggccaccatggtcatttcttcccttctgtcaaacataattcctcggtttggccttcccacctctatactgtctgataacagaccagcctttattagtcaaatcagccaagcgttttttcaggctcttagtattcagtgaaacctttatatcccttacagtcctcagccttcaggaaaggtagaacggactaatgatcttttaaaaacacacctcaccaagctcagccaccaacttaaaaaagactggacaatacttttaccactttcccttctcagaattcaggcctgtccttggaatgctacaaggtacagcccatttgagctcctgtatagacgctcctttttattaggccccagtctcattccagacaccagaccaacttggactgtgccccaaaaaacttgtcatccctactatcttctgtctagtcgtactcctattcaccattctcaactactcatacgtgccctgctcttgtttacactgccagtttacactgtttctccaagccatcacagctgatatctcctggtgctatccccaaaccgccactctgaactcttaaatacataatctttgctggcaggactatgctgaacctcctttggcactctctaatcagatgtcctgagtcatctcaattcttagaccttttatacctgtttttctcctttacttattccgtttagtttttcaattcatacaaaaccgtatccaggtcatcaccaataattctaaatgacgaatgtttcttctaacaaccgcacaatatcaccccttaccacaagacctcccttcagcttaatctctcccactctaggttcccacgccgccccgaatcccgctcgaagcagccctgagaaacatcgcccattctctctctccacaccgccccccaaaaattttcgctgccccaacacttcgacactattttgttttatttttcttattaatataagaaggcaggaatgtcaggcctctgagcccaagctaagccatcgcatcccctgtgacctgcacgcatatataagcccagatggcctgaagtaactgaagaatcacaaaagaagtgaatatgccctgccccaccttaactgatgacattccaccacaaaagaagtgtaaatggctggttcttgccttaagtgatgacattaccttgtgaaagtccttttcctggctcatcctggctcaaaaagcacccccactgagcaccttgccgcccccactcctgcccgccagagaacaaaccccctttgactgtaattttcctttacctacccaaatcctataaaacggccccacccccatctccctgcactgactctcttttcggactcagcccgcctgcacccaggtgaaataaacagctttattgctcacacaaagcctgtttggtggtctcttcacacggacgtgcatgaaa

SEQ ID NO: 631 - DNA, 5658 bp, Homo sapiens
gtcaggcctctgagcccaagctaagccatcatatcccctgtgacctgcacttacacttccagatggccagttcctgccttaactgatcacattccaccacaaaagaagtgaaaatggcctgttcctgcctttgctgatgacattaccttgtgaaattccttctcctggctcatcctggctcaaaagctcccctgctgagcaccttgtgacccccccgcccctgcccaccagagaacaaccccctttgactgtaattttcctttacctacccaaatcctataaaacagccccacccctatctcccttcgctgactctcctttcggactcagcccacctgcacccaggtgaaataaacagccttgttgctcacacaaatcctgtttggtggtctcttcacacggacgtgagtgaaattttggtgccgtgactcggattgggggacctcccttgggagatcaatcccctgtcctcctgctctttgctccgtgagaaagatccacctacgacctcgggtcctcagaccgatcaacccaaggaacatctcaccaattttaaattgggtaagcggcctctctttactctcttctccaacctctcactgtccctcaatctctttctcctttcaatcttggcgccacccttcaatctctcccttctcttaatttcaattcctttcattttctgatagagacaaaggagacacattttatctgtggacccaaaactctggcgccggtcacggactcgggaaggcagccttcccttggtgtttaatcactgcagggacacctctctgattattcacccacatttcactggtgtctgatcaccgtggggacgcctgccttggtcattcacccacattcccttggtggcaagtcagttgcggggactcctgctttggctgctcccccatgttgcagcccagggctgctccccacctcccttctctgtgtctttacccttctctttaaacttacctccttcaccatgggcaaccttccgccctccattcccccttcttctcccttagcctgtgttctcaagaacttaaaacctcttcaactctcgcctgacctaaaacttaaacgccttattttcttctgcaacactgcttggccccaatacaaactcgaaaatggttctaaatgtccagaaaatggcacttttgatttctccatcctacgagacctagataatttttgtcaaaaaatgggcaaatggtctgaagtgcctgacgtccaggcattcttttacacattgttctctccctagtctctgttcccaatgcgactcatccgaaatcctccttctttccctctcgcctgtgctctcagtcccaactccaagcgtcgccgagtctttctttcttttctacagacccatctgacctctcccctcctccccaggctgctcctcaccaggctgagctaggtcccaattcttctttagcctctgctcccccaccctataatccttttatcacctcccctcctcacacccggtccggcttacagtttcgttcctcgactagacctcccccacctgcccagcaatttcctcataaaaagttggctggagctaaaggcatagtcaaggttaataatgctcctttttctttatccgatctatcccaaatcagttagcgtttaggctctttttcatcgaatataaaaacccagctcagttcatggctcgcttggcagcaaccctgagatgctttacagccctagaccctgaaaggtcaaaaggccgtcttattctcaaaatacattttattacccaatccactcccggcattaaataaaactccaaaaattaaattccagccctcaaaccccacgacaggacttaattaacctcgccttcaaggtgtgtaataatagagtaaaggcagctaagtagcaatgtatttctgagttgcaattccttgcctccactgtgagacaaaccccagccacatctccagcacacaagaactccaaacgcccgaacggcagctgccaggggttcctccagaacctcctcccccaggagcttgctacaagtgccggaaatctggccactcggccaaggaaagcccacagcccggaattcctcctaagctgtgtcccatctgtgcgggaccccactggaaattggactgtccaacttgcccggcagccactcccagagcccctggaactctggcccaaggctctctgactccttcccagatcttctcggcttagcggctgaagactgacgctgaccgatcacctcagaagcctacaggatgatcacagaagctttaggtaactctcatagtggaggatggacttaagaagtccgtccccttcttaatcaatacggaggctacccactccatattaccttcttttcaagggcctgtttcccttgactccataactgttgtgggtattgaatgccaggcttctaaacatcttaaaactccccaactctggtgccaacttagacaatattattttaagcacttctttttagttatcctcacctgcccagttcccttattaggttgagacattttaactaaattacctgcttccctgactattcctgggctacagccacacctcattgccgccttttcccccagttcaaagcctccttcacatcctccccttgtatctccccacctcaatccataggtataagacacctttactccctccttggtgaccgattacgcaccccttaccatcccattaaaacctaatcacccttaccccactcaatgccaatatccgatcccacagcccactttaaaaagattaaagcctgttatcacttgcctgttacggcacggccttttaaactctccttacaattaccccattttacctgtccaaaaactggacaagtcttacaggttagttcagggtctacgccttatcaaccaaattgttttgcctatccaccccgtggtgccaaacccatatactctcctatcctcaatacctccctccacaacccattattctgttccagatctcaaacatgctttctttactattcctttgcacccttcatcccagcctctctttgctttcacttggactgaccctgacacccatcagactcagcaaattacctgggctgtactgcctcaaggcttcacagagagcaccccccccccattacttcagtcaagcccaaatttcttccccatctgttacctatctcggcataattctcacaaaaacacatgtgttctccctgctgatcgtgtccgactaatctcccaaatctcaatcccttctacaaaacaactcctttccttgctaggcatggttagtgcagtcagaattcttacacaagagccgggaccgtgccctgtagctttctgtccaaacaacttgaccttactgttttaccctagccctcatgtctgcgtgcagcggctgccactgctttaatacttttagaggccgtaaaaatcacatactatgctcaattcactctctacagttctcataacttccaaaatctattttcttcctcacacctgatgggtatactttctgctccctggcttcttcagctgtactcactctttgttgagtctcccacaattaccattgttcctggcccggacttaatctggcttcccacattattcctgatattacgcctgacccccatgactgtatcactctgatccacctgacattcaccccatttccccatatttccttctttcctgttcctcaccctgatcacgcttggtttattgatggcagttccaccaggcctaatcgccactcaccagcaaaggcaggctatgctgtagtacaagccgctagcccgcctctcagaacctctcatttcctttccatcatggaaatctatcctcaaggaaatcacttctcagtgttccagctgctattctactactcctcagggattattcaggacccccgcccctgccccccgcttccctacacatcaagcttggggatttgccctctcccaggactggcaaattgactttactcacatgctccgagtcaggaaactaaaatacctcttggtctgggtagacactttcactggatgggtagaggcctttcccacagggtctgagaaggtcaccacagtcatttcttctcttctgtcagacataattcctcggtttagccttcccacctctatacagtctgataatggacaggcctttattagtcaaatcacccaagcagtttctcaggctcttggtattcagtgaactgatggtctttttaaaacacatctcacaaagctcagctacaaacttaaaaaggacttgacaatacttttaccactttcccttctcagaattcgggcctgtcctcggaatgctacaagttacagcccatttgagcttctgtaatagactctcgttttattaggccccagtctcattccagacaccagaccaacttgaactgcgccccaaaaaacttgtcatccctactgtcttctgtctagtcatactcctattcaccattatcaactactcataaatgccctgctcttgtttacagtgcctgtttacactgtttctccaagccatcacagctgatatctcctggtgctatccccaaagcgccactcttttttttttttttgagatagagtctcgctctgtcacccaggctggagtgcagtggcgcgatctcagctcactgcaagctctgcctcccgggttcatgccattctcctgcctcagcctcccgagtagctgggactacaggcacatgccaccacgcccggctaattttttgtatttttagtagagatggggtttcactgcattagccaggatggtctcgatctcctgacctcgtgatccgcctgcctcagcctcccaaagtgctgggattacaggccactcccacttaaagtaaataaataatctttgctggcagggctatgctaaacctccttgggcactctctaattggatgtcctgggtcctcccaattcttagccctttaataccggtttttctccttctcttattcggaccttgtgtcttccatttagtttttcaattcatacaaaaccacatccaggccatcaccaatcattctatatgacaatgtttcttctcacaaccccacaatatcaccccttaccacaaaatcttccttcagcttaatctctcccactctaggttcccacgccacccccactcccgctcaaagcagccctgagaaacatcgacgattatctctccataccacgcccaccaaaatttttgctgccccaacacttcaacactattttatgttatttttcttattaatataagaagacaggaatgtcaggcctctgagcccaggctaagccatcatatcccctatgacctgcacgtacacatccagatggccggttcctgccttaactgatgacattccaccacaaaagaagtgaaaatggccagtccctgccttaactgatgacattaccttgtgaccccccactcctgcacaccagagaacaaccccctttgactgtaattttcctttacctacccaaattctataaaatagccccacccctatctcccttcgctgactctctttttggactcagcccgcctgcacccaggtgaaataaacagccttgttgctcacacaaagcctgtttggtgg

SEQ ID NO: 632 - DNA, 452 bp, Homo sapiens
ttagagtaggcagctaggcagacatgagaagggcaggagaggaggtttcccctgcccaattgccagcaatgttaggcaaccatcaggtgaaggtggttgttaaactgcctaaaataataattggtagtctcccaatagatgaaaaacacctgaagctggtgatcagcagcttcccaaaaagatctgaggatttgggcaagcaggcttaatcatgcacactaaggggcaaaatggcagagtttcactggtgtatgaccttcttctaggaacatttgactggtgtggggaaaaaatgcctcagatgagcacatcgcacaacttcagtaaacacactgctcatgtggcccctctcaagtgctgacaggccactgtgtgtttggacagcccccgcaaggaaagaatcaagggagaggaaacacaaaccctggaaccatgccagtgtataaaacccc

SEQ ID NO: 633 - DNA, 123 bp, Homo sapiens
tttggagctcggtgtttgagatgttaagtctgctgatgctcctggccgaataaaggccaaataaagccctttctttcctcaactcgatgtctgagggttttgtctgtggctcgtcctgctaca

SEQ ID NO: 634 - DNA, 161 bp, Homo sapiens
cctttttgagaaaataagaccaagggagctaaccaaagtcaagccccatgcacccaaatcttagcaagcataactatagccaccagttatctgtgtgtgccagcagccttgggatttttgagctgcccttacccatccctttttgtttcattttgatacat

SEQ ID NO: 635 - DNA, 2336 bp, Homo sapiens
gtcatggccctcaggcaagcggactttggaggctctggaaaagggaaagactgggcaaattgaatgcctaatagggcttgctttcagtgcagtctacaaggacactttaaaaaaaagattgtctgaatagaaataagccgcccactcatccatgcctcttatgtcaagggaatcactggaaggcccactgccccaggggatgaagttcctctgagtcagaagccactaaccagatgatccagcaacaggactgagggtgcccggggcaagcgccagcccatgccatcaccctcacagagccccaggtatgcttgaccattgagggccaggaggttaactgtctcctggacagtggcgctgccttctcagtcttactcttctgtgccagacaactgtcctcctgatctgtcactatctgaggggtcctaggacaggcagtcactagatacttctcccaggcactaagttgtgactggggaactttactcttttcacgtgcttttctaattatgcctgaaagccccactcctttgttagggagagacatcctagcaaaagcaggggccattatacacctgaatataggagaaggaacacacatttcttgtcccctacttgaggaaggaattaatcctgacaattaattcctgacaacagaaggacaatatggatgagcgaagaatgcccattcccttcaagttaaactaaaagattcaccttctttccctaccaaaggcagtacccccttagacctgaggcccaacaagtacttcaaaagattaaggacctaaaagcccaaggcctagtaaaatcatgcaatagtgcaatagtccctacaatacttcaattttaggagtacagaaacccaatggagagtggagattagtgcaagatctcaggattatcaatgaggctgctgtccctgtataaccagctgcacctaacccttatgctctgctttcccaaataccagaagaagcagaatggtttacagtcctggaccttaaggatgactttttctgcatcccttacatcctgactctcaattcttctttgcctttgaagatccttcgaacccaacgtctcaactcacctggactgttttaccccaaggtttcaggccatctatttggccaagcattagcccaagacttgagccagttctcatacttggacactctcgtcctttggtatgtgaatgatttacttttagcctcctgttcagaaactttgtgccatcaagccacccaagcgctcttaaacttcctcaccacttgtggctacaaggtttccaaaccaaaggctcagctctgctcacagcagtttaaatacttagggctaaaattatccaaaggaaccagggccctcagtgaggaatgtaaccagcctatactggcttatcctcatcccacaacgctggatactgccaaaggaacctgaaaatgcaggagacaatgctagctattcctgcgaacctctacaggatctgtgcctgctcttcaaatgacaaccgtgaggaaagtaactagaatcgtagatccccgtggccctcccttgtcacatttttctctttactgttctcttacccactttcactctcattgcacctcctccatgctgctgtactaccagtagttcccctcaccaagagcttctatggataatgcagcttcccagaaatactgacacctcattgtataggagtttttctaaaggaaaccccactttcaccccccgtacacatactcgcccagtaagcctatttaataccactctcactgggctccatgaagcctcagcccaaaaccctactaactgttggatgtgcctcaccctgcatttaggccatacatttcaatccctgtatctttaatctccttgttaagtttgtctcttccagaatcgaaggtgtaaaactacaaatcgttcttcaaatggagccccagatgcagtccatgactaagatctactgcggacccctggactggcctgctagccaatgctctgatgttgatgacatcgagggcacctctcccaaggaaatctcaactgcatgacccctgctatgccccaattcagcagaaagcagttagagcagtcgtcagccaacctccccaacagcacttgggttttcctgttgagagaggggactgagagacaggactagctggatttcctaggccgactaagaattcctgaacctagctggggaagctgaccacacccacctttaaacacagggcttgtaactcagctcacacctgaccaatcaggttgtaaagagagcccagtaaaataccaattaggctaaaagcaggaggtaaagaaataatcaa

SEQ ID NO: 636 - DNA, 5612 bp, Homo sapiens
ctgccttaaatgatgacattccaccacaaaagaagtgaaaatggcctgttcctgccttaactgatgacattgtcttgtgaaattccttctcctggctcatcctggctggaaagctcccctactgagtatcttgtgacccccactctggccaccagagaacaaccccgctttgactgtaattttcctttatttacccaaatcctataaaacgtccccacccttatctcccttggctgaccctcttttcggactcagcccagctgcacccaggtgaaataaacagctttattgctcacacaaagcctgtttggtggtctcttccatggatgcaagtgaaatttggtgccatgactcggatcagggtacctcccttgggagatcaatcccctgtcctcctgctctttgctccatgagaaaggtccacctatgacctcaggtcctcagaccgaccagcccaagaaacatctcaccaatttcaaatccagtaagcagcctatttttactctcttcttcaacctccctcactatccctcaacctcgttctcctttcaatcttggcgccacacttcaacctctcccttctcttaatttcaattcctttcattttctggtagagacaaaggagacattttatccgtggacccaaaactccagcgcctgtcacagactgggaaggcagccttcccttggtgtttaatcattgcagggacacctctgattattcactcatgtttcagaggtgtcataccatgcaaggatgcctgccttggtccttcacccttagcagcaagtcctgcttttcttggggaggggcaagtaccccaaccccttctctccgtgtctctaccccttctctgcttttctgaaggagaggcaagaacccctcaaccccttctctttcacccttagcggcaagtcccgcttttctaaaggaggggcaagtaccccgacctcttatctctgtgcccccatcccttatttccacaccccgacctcttatctccgtgccccaaccccttatttctgtgccttgaccccttttctgcttttctggaaggtaagaactcccaaaccccttccctctgtgtctctactctctcttttttctaggcttgcctccttcactataggcaaacttccaccctccattcctcctccttctcccttagcctgtgttcttaagaacttaaaacctattcagctctcacctgacctaaaatctaagcgtcttattttcttctgcaatgctgcttgaccccaatacaaactcacagtagttccaaatagccagaaaacggcactttcaatttttccatcctgcaagatctaaagaattcttgtggtaaaataggcaaacggtctgaggtgcctgacgtccaggcattcttttacacatcagtcccttcctagtctctgtgcccagtgcaactcatcccaaatcttccttctttccctcccgcctgtcccctctgtcccaaccccaagcgtcgctgagtctttctaatcttccttttctacagacccatctgacctctcccctcctccccaggctgctcctcgccaggccaagctaggtcccaattcttccccagcctccagtcctccaccctgtaatctttttatcacctcctctcctcacacccggtccagtttacagtttaattccgtgagtagccctcccctacctgcccagcaatttcctcttaaaaaggtggctaaagctaaaggcatagtcaaagttaatgctcctttttctttatcagacctctcccaaatcagtgagcatttaggctgtttcatcaaatatgaaaaacccagcccagttcatggcttattcggcagcaaccctgagacgctttacagccctagaccctaaaaggtcaaaaggccgtcttattctcaatatacattttattacccaatctgctcccgacattaaataaaactccaaaaattaaattctggccctcaaaccccacaacaggacttaattaacctcaccttcaaggtgtacaataatagagtagaggcagccaagtagcaacgtatttctaagttgcaattatttgcctccacggtgagacaaaccccagccacatctccagcacaacaagaactccaaatacctgaaccacagctgccaggggttcctccagaacctcctcccccaggagcttgctacaagtgccggaaatctagccactaggccaaggaaggcccacagcccaagattcctcctaagccatgtcccatctgtgcaggaccccactgaaaattagactgttcaactcacctggcagccacttccagagcccctggaactgtggcccaaggctctctgactgactccttcccagatcttctcagcttagcagctgaagactgacactgcctgatcgcctcagaagcctacaggaccatcacagatgctctaagtaactctcacagtagaaggtaagtccgtccccttcttaatcaatacggaagctactcactccacattaccttattttcaaaggcctgtttcccttgcttccataactgttgtgcgtattgacagccaggcttctaaacctcttaaaactccccaaatctagtgccaacttagacaatactcttttaagcactcctttttagttatccccacctgcccagttcccttattaggccgagacactttaactaaattatctgcttccctgactattcctaggctacagccacacctcattgctgccttttctcccagttcaaagcctccttcacatcctccccttatatctccccaccttaacccacaagtataagacacctctactccctccttagtgaccgatcatgcaccccttaccatcccattaaaacctaatcactcttaccccgctcaatcccaatatcccatcccacagcatgctttgaaaagattaaagcctgttatcacttacctgttacagcatggccttttaaagcctataaactcttcttgccattcccccattttacctgtcctaaaaccagacaaggcttacaggttagttcagaatctgtgccttatcaaccaaattgttttgcctatccaccccatggtgccaaacccatatactctcttatcctcaatacctccctctacaacccattattctgttctagatctcaaacatgctttctttactattcctttgcacccttcatcccagcctctctttgctttcacttaggctgaccctgacacccattaggctcagcaaattacctgggctgtactgccacaaggcttcacagacagcccccattacttcagtcaagcccaaatttcatcctcatctgttacctatctcggcataattctcataaaaacacacgtgctctccctgctgattgtgccaattaatctcccaaacctcaatcccttataaaacaacaactcctttccttcctaggcatggttagtgcggtcagaattcttacacaagagccaggaccgcaccctgtagcctttctgtccaaacaacttgaccttactgttttagcctagccatcatgtctccgtgcagcggctgctgctgccctaatacttttagaggccctcaaaatcacaaactatgctcaactcactctctacatttctcataacttccaaaatctattttcttcctcatagctgatgcatatactttctgctccccggatccttcagctgtactcactctttgttaagtcccacaattatcattgttcctggcccggacttcaatctggcctcccacattatacctgataccacacctgacccccatgactgtatccctctgatccacctgacattcaccccatttccccatatttccttctttcctgtgcctcaccctgatcacacttagtttattgatggcagttccaccaggcctaatcaccacacaccagcaaaggcaggctatgctatagtacaagccactagcccgcctcttagaacctctgatttcctttccatcgtggaaatctatcctcaaagaaataacttctcagtgctccatctgctattctactacttctcaaggattattcaggccccctcccttccctacacatcaaactcaagggtttgcccctgcccaggactagcaaattgactttactcaacatgccctgagtcaggaaactaaaatacctcttggtctaggtacacactttcactagataggtagaggcctttcccacaaggtgtaagaaggccaccacggtcatttcttccctgctgtcagacataattcctcagtttggccttcccacttctacacagtccgatagaagactggcctttgttagtcaaatcagccaagcattttttcaggctcttaatatccagtgaaacctttatatcccttacagtcctcagtcttcaggaaaagtagaacggactaatagtcttttaaaacacacctcaccaagctcagccaccaacttaaaaaggactagataatacttttaccactttcccttctcagaattcaggcctgtcctcagaatgctacaaggtacatcccatttaagctcctgtatagacgctcatttttattaggccccagtctcattccagacaccagaccaacttggactgtgccccaaaaaacttgtcatccctactatcttctgtctagtcattcctattcactgttctcaactactcatacatgccctgctcttgtttacactgccagtttacactgtttctccaagccatcacagctgatatctcctagtgctatccccaaactgccactctaaactcttgaagtaaataaataatctttgctggcaggactatgctgaatctccttaagcactctctaatcagatgtcctaggtcctcccaattcttagaccttttatacctgtttttctccttctcttattccatttagtttttcaattcatacaaaaccatatccaggccatcaccaataattctacaggacaaatgtttcttctaacaaccccacaatatcaccccttaccacaaaatcttccttcagctgaatctctcccactctaggttcccgcgccgcccctaatcccgctcgaagcagccctgagaaacatcgcccattatctctccataccacccccaaaaattttcaccatctcaacactttaccactatttcattttatttgtcttattaatataagaagacaggaatgtcaggcctctgagcccaagctaagccatcatatcccctgtgaccttcatgtacacatccagatggctggttcctgccttaactgatgacattctaccacaaaagaagtgaaaatggcctgttcctgccttaactgatgacattgtcttgtgaaattccttctcctggctcatcctggctcaaaagctcccctactgagcaccttgtgacccccactctgcccaccagagaacaacccccctttgactgtaattttcctttatctacccaaatcctataaaacggccccacccttatttcccttcactgactctcttttcagactcaggccacctgcacccaggtgaaataaacagctttattgctcacacaaagcctgtttggtggtctcttcacagggacatgaatgaaa

SEQ ID NO: 637 - DNA, 980 bp, Homo sapiens
gtgggggaaagaaagagagatcagactgttactgtgtctatgtagaaaaaggaagacataagaaactccattttgatctgtactaagaaaaattcttctgccttgagatgctgttaatctgtaaccctagccccaaccctgtgctcgcagaaacatgtgctatattgactcaagatttaatggatttagggctgtgcaggatgtgccttggtaaaaatgtttgcaggcagtatgcttggtaaaagtcatcaccattctccaatctcaagtacccagggacacaatgcactgtggaaggccacagggacctctgcccaagaaagcctgggtattgtctaaggtttcccgccactgagatagcctgagatatggccttgtaggaaaggaaagacctccatcccccagcccgacacccataaagggtccgtgctgaggaggattagtgaaagaggaaggcctctttgcagctgagacaagaggaaggcatctgtctcctgcttgtccctgggaatggaatgtctcagtgtaaaacctgatcatatattctatttactgagataggagaaaactgccttatggctggaagtgagacctgctggcggcaatactgctctttactgcactgagatgtctgtgtaaagtcaaacataaatctggcctatgtgcacatccaggcacagcacctttccttaaacttatttatgacacagagtcctttgctcacatgttttcctgctgaccctctggccaccattaccctatagtcctgccacatccccctcgccaagatagtagagatagtgatcaataaatactgagggaactcagagaccaatgctggtgcaggtcctcacttgctgagcaccagtccccttggcccacttttcttcctctatactgtctctgtgtcttatttcttttctcagtgtctcgtctccaccttgcaagaaatacccacaggtgtggagaggcaggccccc

SEQ ID NO: 638 - DNA, 5361 bp, Homo sapiens
gtcaggcctctgagcccaagccaagccatggcatcccctatgacttgcacgtatacatccagatggcctgaagtaactgaagatccacaaaagatgtaaaaatagccttacctgatgacattccagcattgtgatttgtttctgccccaccctaactgatcaatgtactttgtaatctcccccacccttaagaaggttcttcgtaattctccccacccttgagaatgtactttgtgagatccatccctgcccgcaaaacattgctcttaacttcaccgcctatcccaaaacctataagaactaatgataatccaccacaccatttgctgactctcttttcggactcagcccgcctgcatccaggtgaaataaacagccatgttgctcacacaaagcctgtttggtggtctcttcacatggacgcgcatgaaatttggtgccatgactcggatcgcgggacctcccttgggagatcaatcccctgtcctcctgttctttgctccgtgaaaaagatccacctacgacctcaggtcctcagacccaccagcccaaggaacatctcaccaattttaaatcaggtaggcggcctcttcttactctcttctccaacctctctcactatccctcaaccactttctcctttccactcttcaatctctcccttctcttaatttcaattcctttcattttctggtagagacaaacgagacacgttttatccgtggacccaaaactctggcgctggtcacagactgggaaggcagcctttccttggtgtttaatcattgcagggacacctctctgattattcactcacgtttcaaaggtgtcagaccactcagggacgcctgccttggtccttcacccttagcggcaagtcctgcttttctgggggaggggcaagtaccacaaccccttctctccgtgtctctaccccttctctgcatttctgggggaggggcaagtacccctcaaccccttctccttcacccttagcggtaagtcccgcttttctagggggcaagaacccccaatcccttatttccgcaccccgacctcttatctgtgtgccccaatcccttatttccacaccctgacccctttcctgcttttctggagggtaagaaccctcgaaccccttccctccgtgtctctactctctcttttctctgggcttgcctcctttactatgggcaaccttccagcctccattcctccttctcccttagcctgtgttctcaagaacttaaaacctcgtcaactcgcacctgacctaaaacctaaatgccttattttcttctgcaacaccgcttggccccagtacaaacttgacaatggctctaaatggccagaaaacggcactttcgatttctccatcctataagacctaaataatttttgtcaaaaaatgggcaaatggtctgaggtgcctcacatccaggcatttttcacacttcgttccctctcaagtctctgttcccaatgcgattcctcccaaatcctccttctttccctcccgcctgtcccctcagtcccaaccccaagtgtcgctgggtctttccagtcttttctacagacccatctgacctttccccttctcctcaggctgctcgtcgccaggccatctaggtcccaattcttcctcagcctctgctcctccaccctagaatccttttatcacctcccctcctcacacctggtccagcttacagtttcgttcagtgactggccctcccccacctgcccagcaatttactcttaaaaaggtggctggagctaaaggcatagtcaaggttaatgctcctttttctttatcccaaatcagaagcgtttaggctctttttcatcaaatataaaaatccagcccagttcatggctcgttcggcagcaaccctgagacgctttacagccctagaccctaagaggtcaaagggccgtcttattctcaatatacgttttattacccaatctgctcccgacattaaataaaactccaaaaattaaattccggccctcaaaccccacaacaggacttaattaacctcgccttcaaggtgtacaataatagagtagaggcagccaagtaacaacatatttctgagttgcaattccttacctccactgtgagacaaaccccagctacatctccagcacacaagaacttccaaacgcctaaaccgcagtggccaggcattcctccataactgcctcccccaggagcttgctacaagtgccagaaatctggccaccgagccaaggaatgcccgcagcccgggattcctcctaagcgagtcccatctgtgtgggaccccactgaaaattggactgttcaactcacctgacagccactcccagagcccctggaactctggcccaaggctctctgactccttcccagatcttctcggcttaacggctgaagactgacgctgcccgatcgcctcggaagccccatagaccatcacagatgccgagctttaggtaactctcacagtggagagtaagtccgtcctcttcttaatcaatacggaggctacccactccacattaccttcttttcaagggcctgtttcccttgcctccataactgttgtgggtattgacagccaggcttctaaacctcttaaaactccccaactctggtgccaacttagacaatactcttttaagcactcgtttttagttatccccacctgcccagttcccttattaggccgagacactttaactaaattatctgcttccctgactattcctgggttacagctacatctcattgctgccctttccaatccaaagcctcctttgcgtcctcctcttgtattcccccccaccttaacccacaagtataagatacctctactccctccttggcgaccgatcatgcaccccttaccatctcattaaaacctaatcacccttaccccgctcaatgccaatatcccatcccacagtatgctttgaaaggagtaaagcctgttatcacatgcctgctacagcatggccttttaaagcctataaactctccttacaattcccccattttacctgtcctaaaaccagacaagccttacaagttagttcaggatctatgccttatcaaccaaattgttttgcctatccaccccatggtaccaaaccatatactctcctatcctcaatacctccctccacaatccattattctgttctggatctcaaacatgctttctttacaattcctttgcacccgtcatcccagcctctctttgctttcacttggactgaccctgacatccattaggctcagcaaattacctgggctgtactgctgcaaggcttcacagacagcccccattacttcagtcaagcccaaatttcatcctcatctgttacctatctcggcataattctcatgaaaacacacgtgctctccctgctgatcgtgtccgattaatctcccaaacctcaatcccttacaaaacaacaactcctttccttcctaggcatggttagtgtgtcagaattcttacacaagagccaggaccgcaccctgtagtctttctgcccaaacaacttgaccttactgttttagcctagccctcatgtctgcttgcagtggctgccgctgctttaatacttttagaggccctaaaaataacaaactatgctcaactcactctctacatttctcataacttccaatattattttcttcctcatacctgatgcatatactttctgctccccggctccttcagctgtactcactctttgttaagtcccacaattaccactgttcctggcccggacctcaatctggcctcccacattattcctgataccacacctgacccccatgactgtatctctctgatccacctgacattcaccccatttccccatatttccttctttcctgttcctcaccctgatcacgcttgatttattgatggcagttccagcaggcctaatcgccacacagcagcaaaggcaggctatgctatagtacaagccactagcccgcctcttagaacctcatttcctttccattgtggaaatctatcctcaaggaaataacttctcagtgttccatctgctattctactactcctcagggattattcaggccccctcccttccctacacatcaagcttgaagatttgcccccacccaggactggcaaattagctttactcaacatgccccgagtcagataactaaaatacctcttagtctaagtagacactttcactaggtaagtagaggcctttcctacagggtctgagaaggccaccgcagtcatttcttcccttcggtcagacacaattcctcagtttagccttcccacctctatacagtctaacagaccagcccttattagtcaaatcagccaagcagtttctcaggctcttagtattcagtgaaacctttatatcccttacggtcctccgtcttcaagaaaagcagaacggactaaaggtcttttaaaaacacttcaccaagctcagccaccaacttaaaaaggactggacaatacttttaccactttcccttctcagaagtcagacctgtcctcagaatgctacaaggtacagcccatttaagctcctgtatagatgctcctttttattaggccccagtctcattccagacaccagaccaacttagactgtgcccccccccccaaaaaaaacctgtcatcatccctactatcttctgtctagtcatactcctattcaacgttctcaactactcatacatgccctgctcttgtttacactgctggtttacactgtttctccaagccatcacaggtgatatctcctcgtgctatccccaaactgccactcttaactcttgaagtaaataaataatctttgctggcaggactatgctgaatctccttaggcactctctaatcagatgtcctaggtcctcccaattcttagaccttttatacctgtttttctccttctcttattccacttagtttttcaattcatacaaaaccatatccaggccatcaccaatcattctatacgacaaatgtttcttctaacatccccacaagatctcccttcggcttaatctctcccactctaggttcccacgccgcccctaatcccacttgaagcagccctgagaaacatcgcccattctctctccataccaccccacaaaaattttcgctgccccaacacttcaacactattttgttttatttttcttattaatataagaaggcaggaatgtcaggcctgagcccaagccaagccatcgcatcccctatgacttgcacgtacacatccagatggcctgacgtaactgaagatccacaaaagaagtaaaaatagccttaactgatgacattccaccat

SEQ ID NO: 639 - DNA, 5415 bp, Homo sapiens
gtcaggcctcagagcccaagctaagccatcatattccccgtgacctgcacatacacatccagatggccggttcctgccttaactgatgacattccaccacaaaagaagtgaaaatggcctgttcctgccttaactgatgatattaccttgtgaaattccttctcctggctcatcctggctcaaaagctcccctgctgagcaccttgtgacccccacccctgcctaccagagaacaacccccctttgactgtaattttcctttacctacccaaatcttataaaacggccccacccctatctcccttcgctgactgtcttttcggactcagcccgcctgcacccaggtgattaaaaagctttattgctcacacaaagcctgtttggtggtctcttcacatggacatgagtgaaattttggtgccgtgactcggatcgggggacctcctttgggagatcaatctcctgtcctcctgctctttgctccatgagaaagatccacctatgacctctggtcctcagaccaaccagcccaaggaacatctcaccaattttaaattgggtaagcggcctctctttactctcttctccaacctctcttgctatccctcaacctctttctcctttcaatcttggtgccacacttcaatctctcctttatcttaatttcagttcctttccttttctggtagagaccaaggagacacgttttatccgtgaacccaaaactctggcaccggtaacggactcgggaagacagtcttcccttggtgtttaatcacgcagggacgcctgcctgattattcacccacgtttcagaggtgtctgaccatgtggggacgcctgccttggtccttcacccttagtggcaagtaccgcttttctggggggcaagaaccctctgaccccttctctccgtgtctctaccccttctccactttcctggggggcaagcaccccccatcccttctcttcatgtctctactctctcttttctctggacttgcctccttcactatgggcaaccttccaccctccattcctccctcttctcccttagcctgtgttctcagaaacttaaaacctctttaactcacacctgacctaaaacctaagtgccttattttcttctgcaatgctgcttgaccccaatacaaactcgacagtagttccaaatagccagaaaatggcagttttgatttttccatgctacaagatctaaataattcctgtcataaaatggacaaacagtctgaggtgcctgatattcaggcattcttttacacatggttccctccttagtctctgttcccaatgcaactcgtcccaaatcttccttctttccctcccgcctgtcccctcagccccaaccacaagtgtcgctgagtctttcttcttttgaatcttccttttctacagacccgtctgacctctcccctcctccccaggctgctcattgccaggccaagctaggtctcaatttttcctcagcctccactcgcccaccctatagtccttttatcacctcccctcttcacactcggtccggctaacagtttcattctgtgactagccctcccccaagcaatttcctcttaaaaaggtggctggagctaaaggcatagtcaaggttaatgctcctttttcttcatcccaaatcagatagcatttagactctttttcatcaaatataaaaaaccagcccagttcatggctcatttggcagcaaccctgagatgctttacagccctagaccctgaaaggtcagaaggccatcttattctcaatatgcattttactttattacctaatctgctcccaacattaaataaagctccaaaaattaaattccggccctcaaaccctgcaacaggacttaattaacctcgccttcaaggtgtacaataaaagagtagaggcagccaagtagcaacatatttctgagttgcaattccttgcccccactgtgagacaaaccccagccacatctccagcacacaagaacttccaaacacctaaaccgcagtggccaggcattcctccaggcctgcctctcccaggagcttgctacaagtgccagaaatatggccactgggtcaaggaatgcccacagcctgggattcctcccaagccatgtgccatctgtgtgggaccccactggaaatcagactgttcaactcacccggtagccacttccagagcccctaaaactctggcccaaagctctctgactccatcccagatcttcttggtttagcggctgaagactgacactgcccaatcacctcaaaagccctctagaccataacagacaccaagcttcaggtaactctcacagtggagggtaagtccatcccctttttaatcaatacagaggctacccactccacattaccttcttttcaagggcctgtttcccttgcctccataactgttgtattgatggccaggcttctaaacctcttaaaactccccaactctggtgccaacttggacaacactcttttatgcactcttttttagttatccccacctgcccacctcccttattaggccgagacattttaactaaatgatctgcttccctaactattcctaggctacagccacacctcgttgctgccttttctcccagttcgaagcctccttcacatcctcctgttgtatctccccatttaaaccacaagtataggacacctctactccctcctcggcaaccgatcatgcacccctcaccatcccattaaaatctaatcacccttaccctgctcaatgccaatatcccatcccacagcatgttttaaaaggattaaagtctgttatcactcgcctgctacagcatggtcttttaaagcctataaactccctttacagttcccccattttgtctgtccaaaaaccggaaagccttacaggttagttcaggatctgcgccttatcaaccaaattgttttttgcctatccaccccgtggtggcacacccatatactctcctaacctcaatgcctcccttcacaacccattattctgttctggatctcaaacatgctttctttactattcctttgcacccttcatcccagcctctctgctttcacttagactgaccctgacacccatcaggctcagcaaatcacctgggctgtactgccgcaaggcttcacagacagcccgcattacttcagtcgagcccaaatttcttcctcagctgttacctatctcggcataattctcataaaaacacacgtgctctccctgctgatcatgtccagctaatctccaaaaccccaatcccttctacaaaacaacaactcctttccttcctaggcatggttagtgcagtcagaattcttacacaagagctgggaccgtgccctatagcttttttatccaaataacttgaccttactgttttagcctagccctcacgtcagtgtgcggtggctgccgccgccctaatacttttagaggccctcaaaatcacaaactatgctcaactcactctctacagttctcataacttccagaatctattttcttcctcccacctgacgcatatactttctgctccccggctccttcagctgtactcactctttgttgagtctcccacagttaccattgttcctggcccagacttcaatccggcctcccacattattcctgataccacacctgacccccatgattgtacctctctgatccacctgacattcactccatttccccaaatttccttctttcctgttcctcaccctgatcacacttggtttattgatggcagttccaccaggcctaatcaccacacaccagcaaaggcaggctatgctatagtacaagccactagcccgcctcttagaacctctcatttcctttccatcgtggaaatctatcctcaaggaaatcacttctcagtgttccatctgctattctactacccctcagagattgttcaggccccctcccttccctacacatcaaactcggggatttgccccacccaggactggcaaattgatattactcacatgccccaagtcagaaaactaaaatacctcttagtcttggtagacacagggtctaagaaggcgaccgtggtcatttcttcccttctgtcagacataattcctcggtttggccttcccacctctatacagtctgataacggaccagcctttattagtcaaatcacccaggcaatttctctagctcttggtattcagcgaactcatggtcttttaaaaactcacctcaccaacctcagccaccaacttaaaaaggactggacaatacttttaccactttctcttctcagaattcaggcctgtcctcggaatgctacagggtacagcccatttgagctcctgtatagatgctcctttttattaggccccagtctcattccagacaccagaccaacttggactgcaccccaaaaaaacttgtcatccctactatcttctgtctagtcatactcctattcaccattctcaactactcataaatgccctgctcttgtttacgctgccagtttacactgtttctccaagccatcacagctgatatctcttggtgctatccccaaaccgtcactcctaactccctcttaaagtaaataaataatctttgctggcagggctatgctgaacctacttaggcactctctaattggatgccctgagtcctctcaattcttagtcctttaatacctgtttttctctttgtctcattccattcttttttaattcatacaaaaccatatccaggccatcaccaatcattctatatgacaaatgtttcttctaacaaccccgcaatatcaccccttaccacaaaatcttccttcagcttaatctctcctactctaggttcccaagctgcccctaatcccactcgaagcagccctgagaaacatcgcccattctctctccataccacccccaaaaattttcgccgccccaacacttcaacactattttgccttatttttcttattaatataagaagacaggaatgtcaggcctctgagcccaagctaagccatcatatcccctgtgacctgcatgtacacatccagatagccagttcctgccttaactgatgacattccaccacaaaagaagttaaaatggcctgttcctgccttaactgatgacattaccttgtgaaattccttctcctggctcaaaagctcccccactgagcaccttgtgaacccccgcccctgcccaccagagaacaacccccttttgactgtaattttccttcacctacccaaatcttataaaacggccacacccctatctcccttcgctgattctcttttaggactcagcccgcctgcacccagttgattaaaaagttttattgctcacacaaagcctgtttggtggtctcttcgcacggacgcgagtgaaa

SEQ ID NO: 640 - DNA, 2205 bp, Homo sapiens
tgaggtcagaattcttacacaagagccaggaccgcaccctgtagcctttctgtgcaaacaacttgaccttactgttttagcctagccctcatgtctgtgtgcagcagctgccgctgctttaatacttttagaggccctcaaaatcacaaactatgctcaactcactctctgcagttctcataacttccaaaatctattttcttcctcatacctgatgcatatactttctgctccccggctccttcagctgtactcactctttgttgagtctcccacaattaccgttgttcctggcccagacttcaatccggcctgccacattgttcctgataccacacctgacccccatgactgtatctctctgatccacctgatattcaccccatttccccaaatttccttctttcctgttcctcaccctgatcacgcttgatttattgatggcggttccaccaggcctaatcgccacacaccaccagcaaaggcaggttatactatagtacaagccactagcccgcctcttagaacctctcatttcctttccattgtggaaatttatcctcaaggaaataacttctcagtgttccatctgctattctactactcctcagggataattcaggccccctccctttcccacacatcaagctcgaggatttgccccacccaggactggcaaattagctttactcaacatgccctgagtcagataactaaaatacctcttagtctaggtagatactttcactggataggtagaggcctttcctacagggtctgagaaggccaccgcagtcatttcttcccttctgtcagacataattcctcagtttagccttcccacctcaatacagtctgataacagaagggcctttattagtcaaaacagccaagcagtttttcaggctcttagtattcagtgaaacctttatatcccttatggtcctccgtcttcaagaaaagtagaatggactaaaggtcttttaaaaacacacctcaccaagctcagccaccaacttaaaaaggactggacaatacttttaccactttcccttctcagaattcaggcctgtcctcggaatgctacagggtacagcccattggagctcctgtatagatgctcctttttattaggccccggtctcattccagacaccagaccaacttagactgtgcccctaaaaaacttgtcttccctgctatcttctgtctagtcatactcctattcaccgttcctaactactcatacatgccctgctcttgtttacactgctggtttacactgtttttccaagccatcacagctgatatctcctggtgctatccccaaactgccactcttaactcttgaagtaaataaataatctttgctggcaggactatgctgaatctccttaggcactctctaatcagatatcctgagtcgtcccaattcttaagactttttatacctgtttttctccttctgttattccatttagtttctcaattcatccaaaaccgtatctaggccatcagcaatcattctataggacaaatgtttcttctaacatccccacaatatcaccccttaccacaagacctcccctcagcttaatctctcccactctaggttcccacgctgcccctaatcccgcttgaagcagccctgagaaacatcgcccattctctctccataccacgccccaaaaatttttgccgccccaaaacctcaacactattttatttttcttattaatataagaaggcaggaatgtcaggcctctgagcccaagccaagccatcacatcccctgtgacttgcatgtatatgcccagatggcctgaagtaactaaagaatcacaaaagaagtgaatgtgacctgccccaccttaactgatgacattccaccacaaaagaagtgtaaatggccggtccttgcctcaagagatgacattaccttgggaaagtccttttcctggctcatcctggctcaaaaagcacccccactgagcaccttgcaacccccactcctgcccgccagagaacaaaccccctttgactgtaattttcctttacctacccaaatcctataaaacggccccacccctatctcccttcgctgactctttttggactcagcccacctgcacccaggtgaaataaacagccatgttgctcacacaaagcctgtttgctggtctcttcacagatacgcgcatgaaa

SEQ ID NO: 641 - DNA, 33 bp, Homo sapiens
cttggatacaccacactcaagtcaagtcctgaa

SEQ ID NO: 642 - DNA, 989 bp, Homo sapiens
gtggggaaaagagagagatcagattgttactgtgtctatgtagaaaaagaagacataagaaactccattttgatctgtactaagaaaaattgtttctgctttgagatgctgttaacctataactttagccccaaccctgtgctcacagaaacatgtgctgtattggatcagtttaatggatttagggctgtgcaggatgtgccttgttaacaatatgtttgcaggtggtatgcttggtaaaagtcatcgcctttctccattctcgattaaccagggacacaatgcactgcggaaagccgcagggacctctgcccaagaaagcctgggtattgtccaaggtttcctcccactgagacagcctgagatacggcctcgtgggaaaggaaaggccttaccatcccccagcccgacacctgtaaagggtctgtgctgaggaggagtagtgaaagagggaggcctctttgcagttgagataagaggaaggcttctgtctcctgctcgtccctgggaatggaatgtctcggtgtaaagctgaccattcccattcgttctattctgagataggagaaaactgccctgtggctggaggcgagatatgctggcagcaatactgctctgttactctttgctacactgaaatgtttgtgtaaagagaaacgtaaatctagcctacatgcacatccggacacagtacctttccttgaacttattcatgatacagattcctttgctcacgtttccctgctgaccttctccccacctgttgccccgctacactcccctcgtcaagatattaaaaataatgatcaataaatactaacagaactcaagagaccggcgccggtgcaggtcctcgcatgctgggtgtgctggtcccctgggcccactgttctttctttatactttgtctctgtgtcttatttcttttctcagtctctcgtcccacctgacgagaaatacccacaggtgtggaggggcagaccccccct

SEQ ID NO: 643 - DNA, 950 bp, Homo sapiens
gtggggaaaagaaagatcagattgttactgtgtctgtgtagaaagaagtagacacaggagactccattttattctgtactaagaaaaattcttctgccttgagatgctgttaatctgtaaccttaccccgtgctccctgagacatgtgctgggtcaactcagggttaaatggattaagggcggtgcaggatgtgctttgttaaacagatgcttgaaggcagcatgctccttgagagtcatcaccactccctaatctcaagtacccagggacacaaacactgcggaagaccgcagggacctctgcctaggaaagccaggtattgtccaaggtttctccccatgtgatagtctgaaatatggcctcgtgggaagggaaagacctgacagtcccccagcccgacacccgtaaagggtctgtgctgaggaggattagtaaaagaggaaggaacgcctctttgcagttgagacaagaggaaggcatctgtctcctgcccgtccctgggcaatggaatgtctcgtgtaaaacccgattgtatgttccatctactgagatagggggaaaccgccttagggctggaggtgggacacgcgggcagcaatattgctcttcaaggcattgagatgtttatgtgtatgcacatcaaaagcaaagcacttaattctttaccttgtttatgatgcagagacctttgttcacgtgtttacctgctgaccttctctccactattatcctatgaccctgccacatccccctctccgagaaacacccaataatgatcaataaatactaagggaactcagaggccggtgggatcctccgtgtgctgaacgcggtcccctgggcccccttttctctttctctatactttgtctctatgtctcttttccaagtctctcattccacctaacgagaaacactcccaggtgtggaggggcaacccaccccttca

SEQ ID NO: 644 - DNA, 980 bp, Homo sapiens
ttagagtaggtagttaggcagaactgagcagggcaggagagcctgccccaaatgaggaatgtcaggtgaccatcaggtgatggtcaggcggttattaaacggtctctctaaaataataattggttacagctggcatcagggaaaggcagtctcccaatagaaacagctgaagctgggggccaggtgcggtggctcacgcctgtaatcccagcactttgggaggccgaggtgggcgaatcacgaggtcaggagtttgagaccagactggccaacatggtgaaaccctgtctctactaaaaatacaaaaaaaaattagctgggcatagtggcgggtgcctgtaatcccagctactcgggaggctgaggcaagagaattgcttgaacccgggagacagagcttgcagtgagccaagatcgtgccactgcactccagccctggcgacggagtgagactccatctcaaaaaaaagaaaaagaaaaagaaaaaagaaacacctgaaggtgatgaccagcagcttcctgacaggatctgagttgggcgagtgggctcaaacatgcacactaagaggcaaaatgatggagtttaactggagtatgaccttctaggaaaactccactggtaagggaaaaacgactcaatgagcacacgcacaacttcagtaaacacattaagacgcagcccctcccaagtgctggcaggccactgcgcatatggacagcccaccccaaaaaacaaatcaagggaagagaggcacaaaatcccagaagcatgccaacgtataaaaccccaagtcataggtcaaacagcacacttggccctcttcctgctctaaaactttttaataaactttcactccagctctaaaacttgcctcagtctctcactctgccttttgcccctcagacgaatcctttcctcttaggaggtgagcactgagttgctgcagacccacacggatttgccactgctaacagtattt

SEQ ID NO: 645 - DNA, 1441 bp, Homo sapiens
acaatagtccagcttttattagtcaaatcacccaagccgtctctcaggctctcggtattcagtggaaccttcataccccttaccgtcttcaatcttcaggaaaggtagaatggactaatgatcttttaaagacacacctcaccaagctcagcctccaacttaaagaggactggacagtacttttacttcttgcccttctcagaattagcgcctgtccttgagatgctacagggtacagcccttttgaacttttatatggatgtgctttcttgcttggccccaaccttgttccagacaccagccctctgggcaactatcttccagtcctccagcaggctagacagaaaattcaccaggctgctaatcttctcacaaccttccgtagcttctctaataacttctctgctagcatcgcagacatatcacaaactttattaatccttcaggcccaggttgactctttagctgcggttgtcctccaaaaccgccaaggccttgacttactcactgctaaaaaaggaggactctgtatatttttaaatgaagagtgttgtttttacctaaatcaatctggcctagtatatgacaacataaaaaaactcaaggatagagcccaaaaacttgccatccaagtaaataattatgctgaacccccttgggcactctctaattggatgtcctgggtcctcccaattcttagccctttaatacctgtttttctccttctcttatttgtaccttgtgtcttctgtttagtttctcaattcatacaaaaccacacccaggccatcaccaatcattctatacaacaaatgctccttccaacaaccccacaatatcaccccttaccccaaaatctttcttcagtttaatctctcccactctaattacccatgccaccacaatcctgctcaaagcagccctgagaaacatcgcccattatctctccataccacagccaaaattttttgctgccccaacacttctccactattttgttttgtttttccactattttgttttgttttgttttgttttgtcaggcctctgagcccaggctaagccatcatatcccctgtgacctgcaggtatacatctagatggcctgaagcaactgacgaaccacaaaagaagtgaaaataggcagttcctgccttaactgatgactttccaccattgtgatttgttcctgccccgccccaaccaatcaatcgaccttgtgacattcctcccctggacaatgagtctcatgatctcccctctgagcaccttgtgacccctgcacctgcctgcaagagaaaaccccctttaactgtaattttccactgcctacccaaatcctataaaactgccccaccccatctccctttgctgactcctttttcggactcagtctgcctcgcctgcacccaggtgattaaaaagctttattgctcacaca

SEQ ID NO: 646 - DNA, 295 bp, Homo sapiens
gagaagtaatgcaagactccagaagtatgccaatgtatgaaaaccccaagtctagaggtcaaactaggcacttgtctttcaagttgcttgcttggccttcttccaagtgtactttccttcctttcattcttgctctaaagcttttttgtaaactacctctcctgctctaaaacttgcctcagtctctccttctgccttatgtccctcaaattctttcttctgtggagtgtggggggcaagaattgaggatgctgtagacccgtacaaatacggaattgccatcgctaacactttg

SEQ ID NO: 647 - DNA, 411 bp, Homo sapiens
gttaggcctctgagcccaagctaagccatcatatcccctgtgacctgcacgtacacatccagatggccggttcctgccttaactgatgacattccaccacaaaagaagtgaaaatggcctgttcctgccttaactgatgacattaccttgtgaaattccttctcctggctcatcctggctcaaaagctcccccgctgagcaccttgtgacccccagccctgctcgccagagaacaatccccctttgaccgtaattttcctttacctacccaaatcttataaaatggccccgcccctatctcccttcgctgactcttttcggactcaacccgcctgcacccaggtgaaataaacagccttgttgctcacacaaagcctgtttggtggtctcttcacacagacgtgagtgaaa

SEQ ID NO: 648 - DNA, 800 bp, Homo sapiens
agacaggactagctgggcttcctaggccgactaagaattcctaagcctagctggggaaggtgaccgcacccacctttaaacatggggcttgtaactcagctcacacccgaccaatcaggtagtaaagagggctcactaaaatacaaattaggctaaaagcaggaggtaaagaaatagtcaaatcatgtatcatctgaacgcacagggggagggacaataattgggatataaaccccaggcattcgagctgggagtggcaaccccctttgggggaagccgcctttgggtcccctcccattgtatgggaactctgttttcactctattaaatcttgtaactgcacactcttctggtccatgtttgttacagctcgagctgagcttttgctcaccgtccaccactgctgttggccgccatcgcacacctgccactgacttccacccctctggatccggctgggtgtctgctgcactcctgatccagcgaggcgcccactgccactcccagttgggctaaaggctcgccattgttcctgcacagctaagtgcccgggttcatcctaatcaagctgaacactagttgctgggttctacggttctcttctgtgacccatggcttctaatcaagctgtaacactcaccacataggcccaaggtttcattccttggaatctgtgaggccaggaaccccaggtcagagaacaaaaggcttgctgccatcttgggagcggctgccaccatgttgggagcggcccaccaccatcttgggagctctaagaacacagacccacccgtaacatt

SEQ ID NO: 649 - DNA, 6195 bp, Homo sapiens
gacagacaggaccagctggatttcctagactaagaattcctaagcctagctggggaaggtgaccgcgcacccacctttaaacacggggcttgtaactcagctcacacctgaccaatcaggtagtaaagagggctcactaaaatacaaattaggctaaagcaggagataaagaaacagccaaatcatatatcacctgagagcacagggggagggacagtgatcgggatgtaaacccaggcattcgagcagggagcagcaaccccctttgggtcccctcccattttatgggagctctgttttcactctattaaatcttgcaaccgcacactcttctggtccatgtctgttacagctcaagccgagctttcactcgccatccaccactgctgtttgccgccatcgcagacccgccactgacttccacccctccggatatggcaggatgtcttctgtgctcctgatccagcaaggcgcccattgctgctcccaatcgggctaaaggctccccattgttcctgcgtggctaagtgcctgggttctcctaatcgagctgaacactagtcgttgggttccatggttctcttctgtgacccacagcttctaatagagctataacactcaccgcatggcccaaggttccattccttggaatccatgaagccaagaaccccaggtcagagaaaaagaggcttgccaccatcttggaagcagcccaccaccatctcgggagctctaagaacaaggaccctcccagtaacattttggtgaccatgaagggacatccaaagtggtgagtaatattggaccacttttacttgctattctgtcctatccctaccatacaaaggtctgaccagacctaggaggaactcccttcaggacaggacgatagatggttgctcccaggtgattgagaaaaaaaccacaatgggtattcactaattgatagggagactcttgtggaagcagaattaggagaattgccaaataattggtctgctcaaacgctggagctgtttgcactcagccaagccttaaactgcttaaagaatcaaaaaactctatctcaatcctgactcaaaaggttacctacaccctctctgaaacgaatttgcataagaactgttgtttgtgggaatgcatcttaatggggcaactgggttgttatgaaatactctggaacccaccccagctctaggactcaccactgagcacaaaggcaatgttgggcatgctggtaaaggaccactggagtccagcagcccagacccctttctttgtgatcaaggaaggtgggaaaaggggtgcaggactgctacatggtgagtgtaactaatccgataagcagaggtccatgggtggttatgcaccctggaaaggaataagcattaagaccatagaggacgctctaggactaatgctcatcggaaaatgactaggggtgctggcatccctgtgatttttttgttttgttttttgttttgttttttttttcagatgggaagcattccccctaaggcaaatgcccctaagatgtattctggagaatttggcccagtcagagtgtatgtacctttttccctgtcagacttaaagcaaattaaaataggcctaggtaaattctcaaataaccctgatatctatattgacattttacaagggttaggacaaaactttaatctgacatgagagatataatgttactgctagatcagacactaaccccaaataagagaagtaccaccataactgcagcccacgagtttggcgatctcgggtatctcagtcaggtcaatgaaaggatgacaacagaggaaagagaacgattctccacaggccagcaggcagttcccaatgtagaccctcattggaacgcagaatcagaacatggagattagtgcagcagacatttgctaacttgcgtgctagaaggactaaggaaaactaggaagaagcctatgaattattcaatgatgtccactataacacaggaaaaggaagaaaatcctactgcctttctggacagactaagggaggcactgaggaagcatacctctctgtcacctgactctattgaaggccaactaattttaaaggataagtttatcactcagtcagctgcagacattaaagaaaaacttcaaaagtccaccttaggcccagagcgaaacttaaaaaccctattgaacttggcaacctctgttttttataatagagatcaggaggagcaggcggaacgggacaaacgaggtaagaaaaaggccaccactttagtcatggccctcgggcaagcggactttggaggctctggaacgcggaaagcctgggcaaatcgaatgcctaatagggcttgcttccagtgcggtctccaaggacactttaaaaaagattgtccgaatagaaataaaccgcccccttgtccatgccccttatgtcaagggaatcactggaaggcccattgccccaggggatgaaggtcctctgagtcagaagccactaaccagatgatccagcagcaggacagagggtgcccggggcaagcgccagcccatgccatcaccctcacagagccccgggtatgtttgaccattgagggccaggaggttaaccatctcctggacattggcgtggccttcttagtcttactctcctgtcctggacaactgtcctccagatctgtcactatctgaggggtcctaggacagccagtaactagatgcttctcccagccactaagttgtaactggggaactttactcttttcacatgcttttctaattatgcctgaaagccccactcccttgttagggagagacattctagcaaaagcagaggccattatacacctgaacacaggagaaggaacactcgtttattgttccctgcttgaggaaggaattaatcctgaagtctgggcaacagaaggacaatatggatgagcaaagaatgcctctcctgttcaagttaaactaaaggattccgccccctttccctaccaaaggcagtacccccttagacctgaggcccaacaaggactccaaaagattgttaaggacctaaaagcccaaggcctagtaaaaccatgcagtagcccctctgatactccaattttaggagtacagaaacctaatggacagtggaggttagtgcaagatctcagtattatcaatgaggccattgtccctctataccaagctgtacctaacctttacactctgctttcctaaataccagaggaaggagagtggtttacagtcctggaccttaaggatgctttttcctgcatcctgtatatcctgactctcaattcttttttgcctttgaagatccttcgaacctaatatctcaactcacctggttcacggatagcccccatctaattgtccaggcattagcccaagacttgagccagttttcatacctggacactcttgtcctttggtacatggatgatttacttttagccacccattcagaaaccttgtgccatcaagccacccaagcactcttaaatttccttgccacctgtggctacaagatttccaaaacaaaggttcagctctgctcacagcaggttaaatacttagggctaaaagtatccaaaggcaccagggccctcagtaaggaatgtatccagcctatactggctcatccttatcccaaaaccttaaagcaactaagagggttccttggcataacaggcttctgccgaatatggattcccaggtacggcgaaatagccaggccattgtatacactaattaaggaaactcagaaagccaatacccatttagtaagatggacacttgaagcagagcagctttccaggccctaaagaaggccctaacccaagccccagtgttaagcttgccgacggggcaagacttttctttgtatgtcacagaaaaaaacaggaatagctctaggagtccttacacaggtccaagacaccagcttgcaacctgtggcatacctaagtaaggaaaatgatgtaacggcaaagagttggcctcattgtttatgggtagtggcagcaatagcagtcttagtatctgaagcagttaaaataatacagggaagagatcttactgtgtggacatctcatgatgtaaacggcatactcactgctaaaggagacttgttgctgtcaggcaaccgtttgcttaaatatcaggctctattacttaaagggccagtgctgtgactgcgcacttgtgcaactcttaacccagccacatttcttccaaacgataaaagatagaacataactgtcgacaggtgattgctcaaacctacaccactcgaggggaccttctagagtttcccttgactgatcccaacctcaacttgtatactaatggaagttctttgtagaaaaaggacttcaaaaagcagggtatgcagtggtcggtaataatggaatacttgaaagtaatcccctcactccaggaactagcactcagctggcagaactaatagccctcactagggcactagaattaggagaagaaaaaagggtaaatatatatacagactgtaagtatgcttacctacttctccatgaccacgcagcaatatggagagaaagggaattcctaatttcagagggaacacctatcaaacatcgggaagccattaggagattattcttggctgtacagaaacctaaagagatggcagtcttacactgctggggtcatcagaaaggaaaggaaagggaaatagaagggaactaccaagcggatattgaagccaaaagagccacaaggctggaccctccattagaaatgcttatagaaggacccctggtatggagtaatcccctcaaggaaacaaagcaccagtactcaacagaagaaatagattggggaacctcacaaggacatagtttcctcctctcgggagggctagccaccgaagaaggaaaaatagttttgcctgcagctaaccaatggaaattacttaaaacgcttcaccaaatctttcactctcactgcacctcctccatgccgctgtactaccagtagctccccttaccaagagcttctatggagaaatgtggcttcccagaaatattgatgccccattgtataggagtttttctaaaggaaaccccactttcactgcccacactcatatgcccttgcacttcaggccatacatttcaatccctgtatctttaacctccttgttaagtttgtctcttccagaattgaagctgtaaaactacaaatggctcttcaaatggagccccagatgcagtccatgactaagctctactgcggacccctggactggcctgctagcccatgctctgatattaatgacatggaaggcaccccccctgaggaaatctcaactgcacgacccctactatgccccaattcagcaggaagctgttaacagcggtcattggccaacctccccaacagctcttgggttttcctgttgagagggggaactgagagacaggactagctggatttcctaggccgactaagaattcctaagcctagctggggaaggtgaccacacccacctttaaacacggggcttgtaactcagctgacacccaaccaatcaggtagtaaagagggctcactaaaatacaaattaggctaaagcaggaggtaaagaaacagtcaagtcatatatcgcctgagagcacagggggaaggacagtgatcaggatgtaaacccaggcattcgagcagggagtggcaaccccctttgggtcccctcccattttatgggagccctgttttcactctattaaatcttgcaactgcacactcttctggttcatgtttgttacagatcaagctgagctttcactcgccatccaccactgctgtttgccgccattgcagacctgccactgacttccacccctccggatctggcaggatgtctgctgtgctcctgatccagcgaggtgcccattgccgctcccgatcgggctaaaggctcaccattgttcctgcatggctaagtgcctgggttctcctaatcgagctgaacactagtcgctgggttccacggttctcttccgtgacccatggcttctaatagagctataacactcactgcatggcccaaggttccattccttggaatccatgaggccaagaaccccaggtcagactacaagaggcgggctgccatcttgggagcagcccgccatcatcttgggag

SEQ ID NO: 650 - DNA, 429 bp, Homo sapiens
gtcaggcctctgagcccaagccaagccatcacatcccctgtgacttgcacgtatacgctcagatggcctgaagtaactgaagaatcacaaaagaagtgaaaaggccctgccccgccttaactgatgacattccaccattgtgattacttcctgccccaccttaactgagtgattaaccctgtgaatttccttctcctggctcagaagctcccccactaagcaccttgtgacccccgcccctgcccaccagagaacaaccccctttgactaattttccattaccttcccaaatcctgtaaaacggccccacccctaactcccttcgctgactcttttcagactcagcccgcctgcacccaggtgaaatcaacagccattttgctcacacaaagcctgtttggtggtctcttcacagggacgtgcatgaaa

SEQ ID NO: 651 - DNA, 772 bp, Homo sapiens
gagagacaggactagctggatttcctaggccaactaagaatccctaagcctagctgggaaggtgaccgcttccacctttaaacacgtggcttgcaacttagctcacacccaaccagtcaggtaggaaaaagagctcactaaaatgctaattaggctaaacaggaagtaaagaaatagccaatcatctatcgcctgagaacacagtgggcgggacaataatcgggggatataaacccaggcattccagccagcaactgctaccctctttgggtcccctccatttgtatgcgagctctgttttcactctatttcactctattaaatctcccaactgcactcttctggtctgtgtttgttacggctggagctgagctttcgctcgccgtccaccattgctgtttgccgccgccacagacctgccgctgacttccatccctccggatccggcagggtgtctgctgtgctcctgatccagtgaggcgccccttgccgctcccgattgggctaacggcttgagattgctcctgcacggctaagtgcccaggttcgtccttatcgagctgaacactagtcactgggttccatggttctcttccgtgacccacggcttctaatagagctgtaacactcactgcatggctcaagattccattccttggaatccgtgaggccaagaaccccaggtcagagaacatgaggcttgccaccatcttggaagtggcccactgccatcttgggagctctgggagcaaggaccccccggtaacagttt

SEQ ID NO: 652 - DNA, 6629 bp, Homo sapiens
gtcaggcctctgagcccaagcctgcacatatacatccagatggcctgaagtaactgaagaatcacaaaagaagtgaaaatggctggttcctgccttaactgatgacattaccttgtgaaattccttctcctggctcagaggctcccccactgagcaccttgtgaccccctcccctgtctgccggagaacaaccccctttgactataattttccactacctacccaaatcttataaaatggccccacccctatctctctttgctgactctctttttggactcatcctcctgcacccaggcgattaaaaagctttattgctcacacaaagcctgtttggtggtctcttcacatggacgcacatgacatttggtgctgtgactcagatcgggggacctccctcgggagatcaatcccctgtcctcctgctatttgctccatgagaaagatccacctacgacatcgaatcctcagaccaaccagcccaaggaacatctcaccaattttaaatcaggtaagcggcttctttttactctcttctccaacctctctcactatccctcaacttctttctcctttcaatttctgtgtcacccttcaatctctcccttcatttcaatccctttccttttctggtagagacagaggagacacgttttatctgtgaacccaaaactccagcgccagtcatggacttgggaagacagtcttcgcttggtgtttaatgactgaggggatgcctgcttgattattcacccacgtttcagaggtgtctgatcactgtggggacgcctgccttgatccttcacccttagtggcaagtatcactttcctgggggggggcaagcaccccccaccccttatctctgtgtctctaccctctctttactctgggcttatctccttcactatgggcaaccttccaccctccattcctccatcctctcccttagcctgtgttctcaagaacttaaaacctcttcaactcacacctgacctaaaacctaaacaccttattttcttctgcaatgctgcttaaccccaacacaaactcgacaatggttccaaatagccagaaaatggcacttttgatttttacatcctacaagatctagataattcttctcataaaatgggcaaatggtctgaggtgcctgacgtccaggcattcttttacacatcagtctcttcctaatctctgctcccagtgcgactcatcccaaacctttcttctttccctcccacctgtccccacagtcccaaccccaagcgttgctttcaatcttccttttctaccgacccatctgacctctcccttcatcccaagattgctcctcctcaggtaactccccgccaggctgagtcaggctccaattcttcctcagcttccgctcctccaccctataatccttctatcacctcctctccccacacccagtctggcttacagttttgttccgcgactagccctcccccacctcccaacaatttccttttaaaaatggtggctagagctaaaggcatagtcaaggttaatgctcctttttctttatccgacctctcccaaatcagttagcatttaggctttttttcgtcaaatatgaaaacccagcccagtgcatggctcatttggcaacaaccctgagacgctttacagccctagaccctgaaaggtcagaaggccgtctcattctaaatatgcattttattacccaatctgctcccaacattaaataaagctccaaaaattagattctggccctcaaaccccacaacaggacttaacctctccttcaaggtgtacaataatagagaagagttgcaattacttgcctcttctctgagagaaagcctagccacatctccagcacacaagaacttcaaaatgcctaaaccacagtggccaggtgttccttcaggacttcatccctcaggatcttgcttcacgtgctggaaatctggccactgggccaaggaatgcctgtggcccgggatccctcctaagctgtatcccatctatgagggactccactggaaatcggactgtccaactcacctggcaaccactcccagagcccctggaactctggcccaagactctctgactgactccttcccagatcttctcagcttagcagctgaagactgaagctgcccgatcacctcagaagcctcctggaccatcaaagatgctttaggtaactcttacagtggagggtaagtccgtccccttcttaatcaatacagaggctacccactccacattaccttcttttcatgggcctgtttcctttgcctccataactgttgtgagtattgatggccaggcttctaaacctcttaaaactccccaactctggtgccaactaggacaacattcttttatgcactcccttttagttatccccacctgcccagttcccttattaggccgagacattttaactaaattatctgcttccctgactattactgggctacagccacacctcattgccactcttttccccagttcaaagcctccttcgcatcctccccttgtatctccccatcttaatccacaggtatgggatgcctctactccctccctggcaaccacacgcccattactatcccattaaaacctaataacccttaccccactcaatgccaatgccaatatccatcccacaggaggctttaaaaggattaaagcctgttatcactcgcctgttacagcatggccttttaaagcctataaactctccctacaattcccccattttacctgtccaaaaactggacaaatcttacaggttagttcaggatctgcaccttatcaactaaattgttttgcctatccaccctgtggtgcctaacacatacactcttttgtcctcaataccttcctccacaactcactattccattcttgatcttaaagatgcttttttcactattcccctgtaccccttgtcccagcctctctttgcttttacctggactaaccctgacacccatcagtcccagcagcttacctggggtgtactaccacaaggcttcagggacagccctcattacttcagccaagctctttctcataatttactttctttccacccctctgcttctcaccttattcaaaatattgatggccttctactttgtagctcctgctttgaatcttctcaacaagacaacctcctgctccttcaacacttattctccaagggatatccagtatccccctccaaagctcaaatttcttctctgttacctacctcggcataattcttcataaaaacacacataccctccctgccaatcatgtctgactgatgtctcaaaccccaaccccttctacaaaacaactcctttccttcctgggcatggttagatacttttgcctttggatatctggttttgccatcttaacaaaaccgttatataaactcacaaaaggaaacctagctgaccctgtagatcctaaatcttttccccactcctcctttcattccttgaagacagctttagagactgctcccacactagctcttcctgactcatcccaaccctcttcattacacacagtggaagtgcagggctatgcagtgggaattcttacacgaggactgggaccgcaccctgtagcctttttgtccaaacatcttgaccttactgttttaggctggccatcatgtctccatgcagcagctgccactgccctaatacttttaaaggccctcaaaatcacaaactatattcaactcattctctacagttctcataacttccaaaatctgttttctttctcacacctgatgcatatactttctgctccccggctccttcagctatattcactctttgttgagtctcccacaattaccattgttcctggcctggacttcaatccagcctcccacattattccggataccacacctgacccccatgactatatctctctgatccacctgacattcacttcacttctccatatttccttctttcctgttcctcaccctgatcacacttggtttattgatggcagttccaccaggcctaattgccactcaccagcaaaggcaggctatgctatagtatcttccacatctatcattgaggctactgctctgcccccctccactacctgtcagcaagccgaactcattgccttaacttgagccctcactcttgcaaagggactatgcatcaatatttatactgactccaaatatgccttccgtatctttcaccaccatgctgttatatgggcagaaagaggtttcctcactacacaagcgtcctccatcattaatgcctctttaataaaaactttacttacaaaggaagctggagtcattcactgcaagggccatcaaaaggtatcagatcccatcactcagggcaatgcttatgctgataaggtagctaaagaagcagctagcattccaacttctgtccctcatggccagtttttctccttctcattgttcactcccacctactctttcactgaaacttccacctatcaatctcttcccacacaaggcaaatggttcttggaccaaaggaaatatctccttccagcctcacaggcccattctattctgttgtcatttcataacctcttccacgtaggttacaagccgctagcctgcctctcagagcctctcatttcctttccatcgtggacacctatcctcaaggaaatcacttctcagtgttctatctgctattctactgctcctcagggattgttcaggccccctcccttccctacacatcaagctcggggatttgcccctgcccaggactggtaacctgactttactcacatgccctgagtcaagaaactaaaatacctcttagtctaggtagacactttcactgaatgggtagaggcctttcccacagggtctgagaaggccaccacggtcatttcttcccttctgtcagaagtaattcctcggtttggccttcctacctctatacagtctgataacaaaccagcctttattagtcaaatcacccaagcagtttctcaggctctcagtattcagtgaaaccttcataccccttaccgttctcaatcttgaggaaaggtaaaacggactaatggtcttttaaaaacacacctcaccaagctcagccttcaacttaaaaaggactgggcaatacttttaccacttgcccttctcagaattcgggcctgtcctcgggatgctacagggtgcaacccatttgaattcctgtacgaacgctcctttttattaggccctggtctcattccagataccaacccaacttggactgcgccccaaaaacttgtcatccctactatcttctgtctagtcatactcctattcactattctcaactactcttaaatgccctgctcttgtttacactgccagtttacactgtttctccaagccatcacagctaatatctcctggtgctatctccaaaccgccactcttaactgcctcttagagtggacagatgatctttgctgacaaggtacactacaatactctcaccctgatgaaatcctattctttacttttatactcactgttattcttgttcctgttcttatgccaccctctacctctccccagctatctccaccgcactatcaatctcactcactctctcctagccatttataatccttctttaacgaacaattgctggctttgcatttctctttcctccaaaatctcggaggcctcgacttactcactgctaaaaaaaaagaggactctgtatgtttttaagtgaaaagtgttgtttttacctaaatcaatctggcctggtgtatgacaacataaaaaaaactcaaggatagagcccagaaactcaccaaccaagcaagtaattacgctgaacccccttgggcactctctaattggatgtcctgggtcctcccaattcttagtcctttaatacctgtttttctctttctcttattcagaccttgtgtctttcatttagtttctcaattcatacaaaaccatatccaggccatcacgcatcattctatatgacaaatgtttcttctaacaaccccacaatatcaccccttaccacaaaatcttccttcagcttaatctctcccactctaggttcccatgccaccccaatcccactcgaagcagccctgagaaacatcatccattatctctccatatcacccccaaaaattttcgctgccccaacactttaccactatttcgttttatttttcttattaatataagaagacaggaatgtcaggcctctgagcccaagcctgcacatatacatccagatggcctaaaggcctaaaagtaactgaagaatcacagaagaagtgaaaatggccggttcctgccttaactgatgacattaccttgtgaaattccttctcctggctcagaggctcccccactgagcaccttgtgacccccacccctgcctgccagagaacaaccccctttgactataattttccactacctacccaaatcctataaaatggccccaccccatctcccttctctgactctctttttggacacagcccgcctgcaactaggtgattaaaaactttattgctcacacaaagcctgtttggtggtctcttcacacagatgcacgtgaaa

SEQ ID NO: 653 - DNA, 3684 bp, Homo sapiens
gtcaggcgtctcagcccaagccaagccatcgcatcccctgtgacttgcatgtatacgcccagatggcctgaagtaactgaagaatcacaaaagaagtgaatatgccctgccccaccttaacagatgacattccaccacaaaagaagtgtaaatggccggtccttgccttaagtgacgacattaccttgtgaaagtccttttcctggctcatcctgtctcaaaaagcacccccactgagcaccttgcaacccctactcctgcccgccagagaacaaaccccttttgactgtatttttcctttacctacccaaatcctataaaacagccccacacttttctcccttcactgactccctttttggattcagcccacctgcactcaggtgaaataaacagccatgttgctcacacaaagcctgtttggtggtctcttcacacggacgcacatgaaatttggtgccgtgacttggatcgggggacctcccttgggagatcaatcccctgtactcctgttttttgctccgtgagaagatccacctatgacctcaggtcatcagaccgaccagcccaaggaacatctcaccaattttaaatcaggtaagcggcctcttcttactctcttctgcaacctctctcactgtccctcaaccactttctcctttccactcttcaatctctcccttctcttaatttcaattcctttcattttctggaagagacaaaggagacacgttttttccatggacccaaaactccggcactggtcacggactgggaaggcagccttcccttggtgtttaatcattgcagggatgcctctctgattatacacccacgtttcaagggtgtctgaccatgcaggaacacctgccttggtcattcacccttagcggcaattcccgcttttctggggaaggggcaagtacctcaactccttctcgccttgtctctaccccttctctgcttttctgggagaggggcaagtacccttcaaccccttctccttcacccttagcggcaagtcccgcttttctatggggcaagaacacccaatcccttatttccacgccccagcctcttatctctgcaccccaatcccttatttccatgccccaacctcttatctctacaccccaatcccttatttccatgccccaacctcttatctctacaccccaatcccttatttctgcactccgacctcttatctctgtgccccaatcccttatttcagtgcctcaacctcatatctctgcaccccaatcccttatttccatgccctgacctcttatctctgtgccccaaccccttttcccacttttctggaaggtaagaacccccaaaccccttccttccatttctctactctctcttttctctaggcttgcttccttcactatgggcaaccttccatgctccattcttccttctactcccttggcctgtgttctcaaaaacttaaaacctcttcaagtcacacctgacctaaaacctaaatgccttatgttcttctgcaatgccacttgaccccaatacaaactcgacagtagttccaaatagccagaaaatggcactttgaatttttccatcctacaagatctaaataattcttgttgtaaaacaggcaaatggtctcaggtgcctgacgtccaggcattcttttacacatcagtcccttcctagtctctgtgcccagtgcaactcatcccaaatcttccttctttccctcccgcctgtcccctcagtaccaaccccaagtgtcgctgagtctttctaatcttccttttctacagaccaatctgacatctcccttcctccccaggctgctcctcaccaggccaagctacgtcccaattcttcctcagcctctgctcctctaccctataatctttttatcacctcccctcctcacacctggtccggcttacagtttccttccgtgactagccctcctccacctgcccagcaatttactcttaaaaaggtggccggagccaaagatatagtcaaggttaatgctcctttttctttatcccaaatcagaagtgtttaggctccttttcatcaaatataaaaacccagcccagttcatggctcatttggcagcaaccctgagacactttacagccctagaccctaaaaggtcaaaaggccgtcttattctcaatatacattttattacccaatctgctcccaacattaaataaaactccaaaaattggaatctggccctcaaaccccacaacaggacttaattaacctcaccttcaaggcgtacaataacagaaaaaagttgcaattctttgcctccactgtgagacaaaccccagccacatctccagcacacaagaacttccaaatgcctgaaccacagcagccaggcagtcctccagaacctcctcccccaggagcttgctacatatgcaaaatctggccactgggccaaggaatgcccacagcctgggattcctcctaagccgcgtcccatctgtgtgggaccccactgaaaaccggactgttcaactcacctggcagccattcccacagcccctggaactctggcccaaggctctctgactgactccttcagagatcttctccgcttagtggctgaagactgacactgcccgatcgcctcagaagccccctagaccatcacggacgctgaacttcgagtaactctcacagtggcgggtaattccgtccccttcttaatcattacggtggctacccactccacattaccttcttttcaagggcctgtttcccttgattccataactgttgtgggtattgatggccaggcttctaaacctcttaaaactccccaactctggtgccaacttagacaatactcttttaagcactcctttttagttgtccccacctgcccagttcccttattaggccgagacaatttaactaaattatctgcttccctgactattcctggactacagctatatctcattgccacccttcttcccaatccaaagtctcctttgcgtcctcttgtatcccccgaccttaacccacaagtataagatacctctactccctccttggtgaccgatcatgcaccccttaccatctcattaaaacctaatcacccttaccccactcaacaccaatatcccatcccgcagcatgctttaaaaagattaaagcctgttatcactcgtctgctacagcatggccttttaaatcctataaactctccttacaattcccccattttacctgtcctaaaaccagacaagccttacaagttagttcatgatctgcaccttatcaaccaaattgttttgcctatcccccctgtggtgtccaacccgtacactcttttgtcctcaataccttcctccacaactcactattctgtgcttgatcttaaagatgctttttcactattcccctgcaccccttgtcccagcctctcttcgcttccacttagactgaccctgacacccatcaggctcagcaaattacctaggctgtactgccgcaaggcttcatagacagcccctattacttcagtcaagcccaaatgtcatcctcatctgttacctatctcagcatagttctcatgaaaacatatgtgctttccctgctgatcatgtccgattaatctcccaaaccacaatcccttacaaaacaactcctttccttcctaggcatagttag

SEQ ID NO: 654 - DNA, 1701 bp, Homo sapiens
cctccatcattaatgcctctttaataaaaactctgctcaaggccgttttacttccaaaggaagctggagtcattcactgcaagggccatcaaaaggcatcagattccatcgctcagggcaacacttatgctgataaggtagctaaaaaagcaactaggttccaacttctatcccttatggcagtttttctccttctcagctggtcactcccacctactcccccacagaaacttccacctatcaatctcttcccacacaaggcaaatggttcttggaccaaggaaaatatctccttccagcctcacaggcccattctattctgttgtcatttcataacctcttccatgtaggttacaagctgctagcccacctcttagaacctctcatttcctttccatcgtggaaatctatcctcaaggaaatcacttctcagtgttccatatgctattctactactcctcagggattgttcaggccccctcccttccctacacatcaagctcggggatttgcccctgcccaggactggcaaattgactttactcacatgccccaagtcaggaaactaaaatacctcttggtctagtagacattttcactggatggtagaggcctttcccaaagggtctgaaaaggctaccatggtcatttctccccttctgtaagacataattccttggtttggccttcccacctctatacagtctgataacggactggcctttattagtcaaatcacccaagcagtttttcaggctcttggtattcagtggaaacttcataccccttaccgtcctcaatcttcagaaaaggtagaatggactaatggtctttaaaaacacacctcaccaagttcagcctccaacttaaaaaggaggactctgtcaaggataagcccaaaaactcaccaaccaagcaagtaattacgctgaaccctcctgggcactctctaattggatgtcctgggttctcctaattcttagccctttaatacctgtttttctccttctcttattcagaccttgtgtcttccgtttagtttctcaattcatacaaaactgcatccaggccatcaccaatcattctatatgacaaatgcttcttttaacaaccccacaatatcgccccttaccacaaaagcttccttcagcttaatctctcccactctaggttcccacgccgcccctaatcccgctcgaagcagccctgagaaacatctcccattatctctccataccactccccaaaattttcgctgccccaacacttcaacactatgttgttttatttttcttattaatataagaagacaggaatgtcaggcctctgagcccaagctaagccatcatatcccctgtgacctgcatgtatacatccagatggcctgaaacaagtgaagaatcacaaaagaagtgaaaatggctggttcctgccttaactgatgacattaccttgtgaaattccttctcctggctcagaagctcccccactgagcaccttgtgacccctgccggtgccagccagagaataaccccctttgactgtaattttccactacctacccaaatcctataaaactgccccaccccatctccctttgctgactcttttcagactcagcctgcctgcacccaggtgattaaaaagttttattgctgacacaaagcctgtttggtggtctcttcacacggactcgcatga

SEQ ID NO: 655 - DNA, 2086 bp, Homo sapiens
gtcaggcatctgagcccatgacttcacatatacatccagatggcctaaagtaactaaagaatcacaaaagaagtgaaaatggctggtccctgtcttatctgatgacattaccttgtgaaattccttcccctgtctcagaagctcccctagtgagaaccttgtgatccctgcccctgcccacttagaacaaccccctttgactacaatttttcaatacctacccaaatcctataaagcagccacactgctatctctcttcactgactctcttttgtacacagcccacctgcatccaggtgaaataaacagccttgttgctcacacaaatcctgtttggtggtctctttacacagacgtgcatgacatttggtgccaaaacaccaccatgctgttatatgggctgaaagaggtttgctcactacacaagtgtcctccatcattaatgcctctttaataagaaggcttctcaaggctgctttacttccaagggaagctggagtcattcaccacaggggccaccaaaaggccccagatcccatctctcagggcaattcttatgctgatatggtagctaaagaagcggttagcattccaacttctgtccctcatggtcagtttttctccttctcatcagtcactcccaactacttcccacctgaaacttccaactatcaatctcttcccacacaaggcaaatagttttggaccaaggaaaatatatccttccagcctcacaggccaattctattctgtcatcatttcataacctcttccttgtaggttacaagctgctagcctgcctcttaaaacctctcatttcctttccatcatggaaatctatcctcaaaatatcacttctcagtgtttcatatgctattctactactcctcaggaatttatcagactctctcccttccctacatatcaagcatgaggatttgcccctgtccaggacttgcaaattgactttgctcacatgccctgagacaggaaactaaaatacctcctggtctaggcatacactttcactggatatgtagaggcttttcccatacagtcagacaaggccacttcagtcatttcttcccttctgtcagacacaattcctcggcttggccttcccacctctgtatagcccaataacagacaggcctttattagccaaatcacccaagtagtttctcaggctcttggtattcagtggaaacttcataccccttacaatcctcaatcttcaggaaaggtagaacagactaatggtcttttaaaaatacacctcaccgagctcagcatccaactgaaacaggagggctctgtcaagtatagagccaaaaaactcaccacccaaactgaatccccttgggcactctctaatttgatgtactgggtcctcacaattcttagtccttgaatacctctttttctacttctcttatttggaccttgtgtcttccatttagtttctcaattcttacaaagccatatctaggcctttaccaatcattttatatgacaaatactccttctaacaatcccaaaatatcactgcttaccacaaaatcttccttcagcttaatctctcccactctagtttcccatgtgacccataatcttgctcaaagaagccctgagaaaattgcccattatctttccatatcacccacaaaatttttcacgaacccaacactttaccactattttgttttattttccttattaatataagaagacaggaatgtcaggcctctgagcccaagccagcaggtatacatccagatggcatgaagcaactgaagaatcacaaaagaagtgaaaatgactggttcctgccttaactgatgacattaccttgtgaaattccttctcctggctcagaagctctcccactgagcaccttgtggccaccagagaacaacctcctttgactgtaattttccactacctaccttaatcctataaaaggccccaccccatctccctttgctcactctcttctcagacacagcccacctacccccaggtgattaaaaagctttattgctcatacaaagcctgtttggtggtctcttcacacggacacatgtga

SEQ ID NO: 656 - DNA, 3774 bp, Homo sapiens
acaaatcaaatgcctaatagggcttgcttccagtgcggtctacaaggacactttaaaaaaggttgtccaggccgggcgtggtggctcacgcctgtaatcccagcactttgggaggccgaggcgggcggatcacgaggtcaggagatcgagaccatctcggctaaaacggtgaaaccccgtctgtactaaaaatacaaaaaattagccgggcgtagtggcgggcgcctgtagtcccagctacttgggaggctgaggcaggagaatggcgtgaacccgggaggcggagcttacagtgagccgagatcccgccactgcactccagcctgggcgacagagcgagactccgtctcaaaaaaaaaaaaaaaaaaagaaaaaaaaaaaggttgtccagatagaaataagccgccccctcttccatgccctttatgtcaagggaatcactggaaggcccactgccccaggggacaaaggtcttctgagtcagaagccactaaccagatgatccagcagcaggactgagggttccccggggcaaacgccagcccatcaccctcacagtgtcccagatatgcttgaccattgagggccaggaggttaactgtctcctggacgctggcacagccttctcagtcttactctcctatcccagacaactgtcctccagatctgtcactatctgaggggtcctaggacaggcagtcactagatacttctcccagccactaagttgtgactggggaactttactcttttcacatgcttttctaattatgcctgaaagccccactcccttgttagggagagacattctagcaaaagcaggggccattatacccctgaacataggagaaggaacacacatttgctgtcccctgcttgaggaaggaattaatcctgaagtctgggcaacagaaggacaatatggacgagcaaagaatgcccatcctgttcaagttaaactaaaggattccgcctcctttccctaacaaaagcagtacccccttagacccgagccccaacaatgactccaaaagatttttaaggacctaaaagcccaaggcctagtaaaagcatgcaatagcccctgcaatactccaaatttaggagtacagaaacccatcagacagtggaggttagtgcaagatctcaggattatcagtgaggccgttgtcactccatacccagctgtacctaacccttatactctgctttcccaaataccagaggaaatagagtggtttacagtcctggactttaaggctgcctttttctgcatcgctgtgcatcctgactctcagttcttgtttgcctttgaagatccttcaaatccaatgtctcaactcacctggactgttttaccccaagggttcaaggatagcccccatctatttggccaggcattagcccaagacttgagccaattctcatacctggacactcttgtccttcagtacgtggataatttacttctagctgcccgttcagaaatcttgtgccatcaagccacccaagcgcttttaaacttccttgccacttgtggctataaggtttccaaaccaaaggctcagctctgcttacagcaggttaaatacttatggctaaaattatccaaaggcaccagggccctcagtgaggaatgtatccagactatactggcttatcctcattccaaaaccctaaaagcaattacgagggttccttggcataacaggcttctgccaaatatggattcccaggtacggcaaaatagccaggccattatatacactaattaaggaaactcagaaagccaatacccatttagtaagatggatacctgaagcaaaagcagctttccaggccctgacaaaggccctaacccaagccccagtgttaagtttgccaacggggcaagacttttctttatatgtcacagaaaaaacaggaatagctctaagagtccttacacaggtccaagggaccagcttgcaacccgtggcatacctgagtaaggaaattgatgtagtggcaaaatgttggcctcattgtttacgggtagtggcagcagtagcagtcttagtttctgaagtagttaaaacgatacagggaagagatcttactgtgtggacatctcatgatgtgaacggcatactcactgctaaaggagacttgtggctgtcagacaaccgttcgcttaaatatcaggctctattaattgaagggccagtgctgtgactgcacacttgtgcaactcttaacccagccacatttcttccagacaatgaagaaaagatagaacataactgtcaataggtgattgctcaaacctacacttctcaaaatgaccttctagaggttcccttgactgattctgacctcaacttgtatactgatggaagttcctttgtagaaaaaggacttcaaaaagcggggtatgcagtgctcagtgataatggagtacttgaaagtaatcccctcactccaggagctagtgctcagctggcagaactaatagccctcactcgggcactagaattaggagaaggaaaaagggtaaatatatatatagactctaagtatgcttacctagtcctccatgcccacgcagcaatatggagagaaaggaaattcctaacttccaagagaacacctatcaaacatcaggaagccattaggagattattattggctgtacagaaacctaaagaggtggcagtcttacactgctgggggcatcagaaaggaaaggaaagggaaatagaagtgaaccgccaagtggatattgaaaccaaaagagccacaaggcaggaccctccattagaaatgcttatagaatgacccctagtatggagtaatcccccctgggaaaccaagccccagtactcagaaaaagaaatagaatgcggaacctcacgaggacatagtttcctctcctcaggatggctaaccactgaagaaggaaaaatattttacttgcagctaaccaatggaaattacttaaaacccttcaccaaacctttcacttaggcattgatagcacccatcagatggccaaattattatttactggaccaggccttttcaaaactgtcaagaaaagaaataatctgccaaagaaataatttttcaaaactgccaaagaaataatcccctgcactgcaggccatacatttcaatccctgtgtctttaacccctttgttaagtttgtctcttccagaatcaaagctgtaaaactacaaatcattcttcaaatggagccccagatgcagtccatgactaagatctaccatggacccctggaccggcctgctagcccatgctccgaagttgatgacatcgaaggcacccctcccaaggaaatttcaactgcacgacccttactatgccccaattcagcaggaagcagttagagctgtcgtcagccaacctccgcaagagcacttgggttttcctgttgagaggggctactaagagacaggactagctggatttcctaggccaactaagaatccctaagcctagctgggaagttgaccacatccacctttaaacacgaggcttgcaacttagcttacacacaaccaatcaggtagtaaagagagctcactaaaatgctaactaggcaaaaacaggaagtaaagaaatagccaatcatctattgcctgagagcacagggggagggacaatgatcgggatataaacccaggcatcggagccggcaatggctgtcccctttgggtcccctccctttgtatgggagctctgtttttactctattaaatcttgcaattgca

SEQ ID NO: 657 - DNA, 2152 bp, Homo sapiens
tcccacattattcctgatacgacacctgacccccatgcctgtatctctctgatacacctggcattcactccatttctccatatttccttctttcctgttcctcccctgatcacatctggtttatttttatttttatttatttattttttttgagacagagtctcgctgtcgcccaggctggagtgcagtggtgcgacatctggtttattgatggcagttccaacaggcctaatcaccattcaccaccaaagacaggctatgctatagtattttccacatctatcactgaggctaccgctctgccccctccactacctctcagcaagctgaactcattgacttaactcgggctctcactcttgcaaagggattacttgtcaatatttatactgattctaaatatgccttccatatcctgcaccaccatgctgttatatgggcagaaagaggtttcctcactatgcaagggtcctccatcattaatgcctctttaataaaaactcttttcaaggtcgctttacttccaaaggaagctggagtcattcaccgcaagggccatcaaaaggcatcagatcccatagctccgggcaatgcttatgctgataaggtagctaaaaaagcagctagggttccaacttctatccctcacggcaatttttctcctcatctggtcactcccacctactcccccactgaaacttccacctatcaatctcttcccaaacaaggcaaatggttcttggaccaaggaaaatatctccttccagcctcacaggcccattctattctgtcatcatttcataacctcttccatgtaagttacaagctgctaacccgcctcttaaaacctctcttttcctttccatcgtaaaaatctatcctcaaaaaatcacttctcagtgttccatctgctattctactactcctcaggaatttctcaggtcccctcccttccctacacatcaagcttgagaatttgcccctgcccaagactggcaaattgactttactcccatgccccgagtcaggaaactaaaataactcttggtctgggtatacactttcactggatgggtagaggcctttcccacagggtctgagaaggccaccatggtcatttcttcccttgtgtcagacataattcctcagtttggccttcccaactctatacagtccaataatggactggcctttgctagtcaaatcacccaagcagtttctcagtcttttggtattcagtgaaaccttcataccccttaccatcctcaatcttcaggaaaggtagaacggactaatggtcttttaaaaacacacctcaccaagctcagcctccaacttaaaaaggaggactctgtcaaggatagagcccaaaaactcaccaaccaagcaagtaattacgctgaacccccttgggtactctctaattggatgtcctgggtcctcccaattcttagtcctttaatacctgtttttctccttctcttattcagaccttgtgtcttccatttagtttctcatttcatacaaaaccacatccaggctattaccaatcattctatatgacaaatcctccttttaacaaccccacaatatcgcctcttaccacaaaatcttccttctgcttaatcgctcccactctaagttcccacgccacccctaatcccactcgaagcagccctgagaaacattgcccattatctctccatacaacccccaaaattttcaccaccccaacacttcaccactattttgttttatttttcttattaatataagaagacaggaatgtcaggcctctgagcccaagcttgcacatgtacatccagatggcctgaagcaagtgaagaatcacaaaagaagtgaaaatggtcagttcctgccttaactgatgacattaccttgtgaaattccttctcctggctcacgagctccccccactgagcaccttgtgacccctgcccctgcctgccagagaacacccccctttgactgtaattttccactacctacccacatcctatataacagccccaccctatctcccttcactgactctctttttgggctcagcccgcctgcacccaggtgaaataaacagccttgttgctcacacaaagcctgtttggtggtctcttcacacagatgcgtgtga

SEQ ID NO: 658 - DNA, 967 bp, Homo sapiens
gtggggaaaagaaagagggatcagattgttactgtgtctgtgtagaaagaagtagacataggagactccattttgttctgtactaagaaaaattcttctgccttgagatgctgttaatctgtaaccttacccccaaccctgtgctctctgaaacatgtgctgtgtcaactcagggttaaatggattaagggctgtgcaagatgtgctttgttaaacagatgcttgaaggcagcatgctccttaagagtcatcaccactccctaatctcaagtacccaggcaaacactgcggaaggcttcagggacctctgcctaggaaagccaggtattgtccaaggtttctccccatgtgatagtctgaaatatggcctcgtgggaagggagagacctgaccatcccccagcccgacacccgtaaagggtctgtgctgaggagaattagtaaaagaggagggaatgcctctttgcagttgagacaagaggaaggcatctctctcctgcgcgtccctgggcaatggaatgtctcagtgtaaaacccaattgtatattccatctactgagataggggaaaaccgcctcaggggtggaggtgggacatgcggtgggcaatactgctctttaaggcattgagatgtttatgtgtatgcatatctaaagcacagcacttaattctttaccttgtctatgatgcagagacctttgttcacctgtttatctgctgaccttctctccactattatcctatgaccctgccacatccccctctctgagagagaaacacccaagaatgatcaataaatactaagggaactcagaggctggcaggatcctccatatgctgaacgctggtcccctgggcccccttatttctttctctatactttgtctccgtgtctttttcttttccaagtctcttgttccacctaacgagaaacacacacaggtgtggaggggcaacccgccccttca

SEQ ID NO: 659 - DNA, 105 bp, Homo sapiens
tctgcggctgctgaaacctgggaggcaaaaccgagcccggacaacccctgcaaagtaactctgaggaagatgacaagcccagctccagtcatacctggaagctga

SEQ ID NO: 660 - DNA, 701 bp, Homo sapiens
ttagagtaggtagttaggcagacatgagcaggacccgtgaggcccctccccaaccagaaatatcaggcaatgatggtcaggtggttgttaaactgtctctctaaaatagtaattggttgcagccggcaccagggaagggccgtctcccaatagataggaaacacctgaagctggggatcagcaacttcctgataatatctcaggagttgggcaactgggctcaagcatgcaccctaagaggcaaaatggcaaagtttaactggtatacgaccttcctctagaaacacttgacgggtaagggaaaaatgattcaaatgagcatgtgtgcaacttcagtaaatacactgccccttccaagtgctgacaggccactgtgcatgcagacagcccaccccaagggaagaatcaggggagaagagatgcaaaacccagaagcatgctaacaaaaccccaagtcaaagtcaaactgtgcccttggatgtctcaagttaccctcttagccctcttctaagtaaaggtaaaataacaactttacttccttttgttcctgctctaaaactttttaataaactttcactcctgctctaaaatttgcctcagtctctgcctctgccttgtgcccctcagccgaattctttcttcttagggggcaagaattgaggtcgttgcagaccgatacagattcgctgctgctaacaata

SEQ ID NO: 661 - DNA, 10347 bp, Homo sapiens
agagacaggactagctggatttcctaggccaactaagaattcctgagcctagctggggaaggtgactgcacccatctttaaacatggggcttgtaactcagctcacacccgaccaatcaagtagtaaagggagctcactaaaataccaattaggctaaaagcaggaggtaaagaaatagtcaatcatctatcgcctgagagcacagcgggagggacaatgatcaggatataaacccaggcattggagccaacagtagcaacccccttttggtcccctcccattgtatgagagctctgttttcactctattaaatcttgcaactgcacactcttctggtccgtgttttttccggcttgagctgagcttttgcttgccatccaccactgctgatcaccaccgtcgcagacccgtcactgacttccacccctccggatctggcagggtgtctgctgctcttctgatccagtgagacacccattgccactcctgactgggctagaggctcgccattgttcctgcatggctaagtgcccgggttcatcctaatcgagctgaacactagtcgctgggttccacggttctcttccataacccatggcttctaatagagctataacactaaccacatggcccaaggttccattctttggaatccatgaggccaagaaccccaggtcagagaatagaaggcttgctgccatcttgggagcggcccaccaccatcttgggagctctaagaacaaagacccgcttgtaacatttggtggcccatatggggattctccaaagtggtgagtaatactgggccatttttgcttgctattctgtcctatccttccttggaattggaggaaaatatagggcacctatcggctggttaaaaatgattagcgtggccgccggagtgaggctttctggaaaaaggctttctaacaacccccaacccttctgtgttgggagcattggtctgcctggaaccagcttctgttttcacaatattcctgggggaagccgagggccaactagaggcagaaagctgtcgtcctgaactcctggcattggccagttgagatcatggtgcagccagaagtctctactcaacagtcgtccatgcgtgtgcccctacctctccttctgacccatacctcctgggtcctgaccatgactttcttgaaagtgtagccccaaaattctccttacctctgtatctacttcctcctatccctgtctcctaggtactaatgcttcaggctttcacttcctttcccaagtattagagcaagttgtatctccaaagggatctaaggaagctctacactgcatccttaggcacctaggctatgaatgcagggaatcttgtccctggtgtctctcccaatttaggtatacagctctcgacatgggcagttatgtgggatccattccccaccacactagccagggccccaagttctattatgagctgtggaccaagtttgtaaatggctaggaggattgatcttccactgtgtaagatgttcttctcccccaatttctacccagtttacccaccctgtaatacaatctccaagccttggctccttggccagggccttagaactgatgacccagtactttaataattggaactgggtctatgacaacataatagatcaggatgaaaacgaattgagtaaattaaagggaggcacatattcctataacggcaaatgggggcaacgagcgaacgtccttccactgtgttcccaaaatccatctaccaagagaggaattatctctttcacagctttgcctagtgattctatgtaagtcaatactactggaaggacaacatagtgcccagaagtttattaactggactttagcacataaaaaccagcaagcccacgccgggcatggtggctcacacctgtaatcccagcactttgggaggccgagacgggtggatcacctgagatcaggagttcgagaccagcctggccaacatggtgaaaccccgcctctactaaaaatacaaaaattagccgggtgtggtggtgggcgcctgtaatcccagctactcaggaggctgaggcagaagaatcacttgaacctgggaggcagaggttgcagtgagccaagatcacgccactgcactccagcctgggtgatggagcaagactccatctcaaaaaaaaaaaaaaaacaaaaaaaacccagcaagcccatccttttctcattgctctccttctcgtaggaaaaaggcacacaagataaacaggatccatctctcctatttcttacccaaaaggacttaatctggggcaacaagaggtttaagatagataattagggcatattcctgcaaaggaaaagaaggataaaggccctagtggggaaaaattctatctcaatcctgactcaaaaagttacttacaccctctctgaaatgaatttgcataggaactgttgcttatgggaccaactgggttgcaactgggttgcagatggggcaactgggttgttatgaaatactcaggaaaccagcccagctctagaactcacccctgagcacaaaggtgatgttgggcacactggtaaaggaccactagaatccagcagcctggacccctttctttgtggtcaagaaaggcaggaaaacaggtgcaggactgctacatcggtgagcataactaatccgataagcagaggtccatggctggtcacacaccctggaaaggaataagcgttaggaccatagaggacactctaggactaatgctcatcggaaaatgactaggggtgctggcattcctatgttcttttttcagatgggaaatgttcccccggctccttccccaactaataaggaccccccttcaacccaaaccgtccaaaaggagatagacaaaggggtaaacaatgacccagagtgccaatattccccgattatgccccctccaagcggtgggaggaggagaattcagcccagtcagagtgcatgtaccgtttttccctctcagacttgaaacaaactaaaatagacctagataaattctcagataaccctgatggctatattgatgttttataagggttaggacaatcctttgatctgacatggagagatataatgttactgctagatcaaactgtaaccccaaatgagagaagtgctgccataactgcagcctgagagtttggtgatctctggtatctcagtcagttcaatgataggatgataacagaggaaagagaatgattccccacaggccagcaggcagttcccagtgtagaccctcactgggacacagaatcagaacatggagattggtgccgcagacatttgctaacttgcatgctagaaggactaaggaaaactaggaagaagcctatgaattattcaattatgtgcactataacacagggaaaggaagaaaatcctattgccttcctggagagactaagggaggcattgaggaagcatacctctctgtcacctgactctattgaaggccaactaatcttaaaggataagtttatcactcagtcagctgcagacattagaaagaaacttcaaaagtctgccttaggcttggaacaaaacttagaaaccctattgaacttggcaacctcggtttttaataatagagatcaggaggagcaggtggaatgggacaaacgggttaaaaagaaaagccaccgctttagtcatggccctaaggcaagcggacttcggaggctctagagaaaggaaagcctcagcaaatagaatgcctaatagggtttgtttccagtgcagtctacaaggacgctttaaaaaagattgtctggccgggcgcggtggctcacgcctgtaatcccagcactttgggaggctgaggcaggtggatcacaaagtcaggcgatcaagaccatcctggctaaaacagtgaaaccccatctctactaaaaatacaaaaaattagctgggtgtggtggcgggcgcctgtagtcccagctcctcgggaggctgaggcaggagaatggcgtgaaaccgggaggcggaggttacagtgagccaagattgggccactgcactccagcctgggtgacagagcaagactccctctaaaaaaaaaaaaaaaaagattgtctgaatagaaataagccgccccctcgtacatgccccttatgtcacgggaatcactggaaggcccactgccccagggtacgaaggtcctctgagtcagaagccactaaccagatgatccagcagcaggactgagggtgcctggggcaagcgccatcccatgccatcaccctcacagagccccaggtatgcttgaccattgagggccaggaggctaactgtcttctggacagtgcaggcttctcagtcttactctcctgtcccagacaactgtcctccagatctgtcactatccgaggggtcctaggacaggcagtcactagatacttttcccagtcactaagctgtgactggggaacttttttcacatgcctttctaattatgcctgaaagccccactcctttgttagggagagacattctagcaaaagcaggggccattatacacctgaacataggagaaggaacacccattttttgtcccctacttgaggaaggaattaatcctgaagcctgggcaacagaaggacaattggacgagggaagaatgcctgtcctgttcaagttaaactaaaggattccgcctcctttccctaccaaaggcagtacccacttagacccgaggcccaacaaggactccaaaagattgttaaggacccaaaagcccaaggcctagtaaaagcatgcaatagcccctgcaatactccaattttaggagtacagaaacccaatggacagtggaggttagtgcaagatctcaggattatcaatgaggccattgtccctatatacccagctgtacctaacccttatattctgctttcccaaataccagaggaagcagagtggcttacagtcctggaccttaaagatgcctttttctgcatccctatacatcctgactctcaattcttgtttgcctttgaagatccttggaacccaacatctcaacccacctggactgttttaccccaagcggtcagggatagcccccatctatttggccaggcattagcccaagactttagccagttcttatacttggacactcttgtcctttggtatgtggatgatttacttttagctgcccgttcagaaaccttgtgccatcaagccacccaagcgctcttaaacttcctcgccacctgtggctactaggtttccaaaccaaaggctcagctctgctcacagcaggttaaatacttagggctcaaattatccaaaggcaccagggccctcagtgaggaatgcatccagcctatactggcttatcctcatcccaaaaccctgaagcaattaggagggttccttggcataacaggcttctgccgaatatggaatcccaggtatgtcaaaatagccaggccattatacacactaattaaggaaactcagaaagccaacactcatttagtagaatggatacctgaagcagaagcagcttcccaggccctaaagaaggccctaacccaagccccagtgttaagcttgtcaacggggcaagacttttctttatatgtcacagaaaaaacaggaatagctctaggagtccttacacaagtccgagggaccagcttgcaacccgtggcatacatgagtaaggaaattgatgtagtggcaaagggctggcctcattgtttatgggtagtggcagcagtagcagtcttagtatctgaagcagttaaaatgatacagggaagagatcttactgtgtggacatctcatcatgtgaatggcatactcactgctaaaggggacttcgggttgtcagacaaccatttgcttaaatatcaggccagtctattacttgaagggccagtgctgcaactgcacacttgtgcaactcttagccacatttcttccagacaatgaaaaaaagatagagcataactgtcaacaagtgattgctcaaacctatgccactcaaggggaccttctagaggttcccttgactgatccccacgtccccacatcaacttgtatactgatggaagttcctttgtagaaaaatgacttcgaaaggcgaggtatgcagtggtgagtgacaatggaatacttcaaagtaatcccctcactccagaaactagcgctcagctggcagaactaatagccctcacttgggcactagaacacaggagaaggaaaaagagtaaatatatatacagcctataggtatgcttacctagtcctccatgcccacgcagcaatatggagagaaagggaattcctaacttccaagggaagacctatcaaacatcaggaagacattaggagattattattggcggtacagaaacctaaagaggtggcagtcttacactgccagggtcatcagaaaggaaaggaaagggaaatagaagagaaccaccaagcggatactgaagtcaaaagagccgcaaggtgggaccctccattagaaatgcttatagaagggcccctagtatggggtaatcccctccaggaaaccaagccccagtactcagcaggagaaatagaatggggaaccgcatgaggacatagcttcctcccctcaggatagctagccactgaagaaggaaaaatacttttgcctgcagctaaccaatagaaattacttaaaacccttcacccaacctttcacttaggcattgataacacccatcagatggccgaatcattatttactggaccaggccttttcaaaactaccaagcagatagtcagggccggtgaagtgtgccaaagaaataatcccctaccttattgccaggctccttcagaacaaagaacaggccattacccaggaaaatactggcaactagattttacccacatgcccaaatctcagggatttcagtatctactagtttgggtggatactttcactggttgggcagaggccttcccttgtaggacagaaaaggcccaagagataataaaggcactaattcattaaataattcccagagttggacttccccaaggcttacagagtgacagcggccacgctttcaaggctgtaggaacccagggagtatccgaggagttaggcatacaatatcacttacaccatgcctggaggccacaatcctcaggaaaagtcgagaaaatgaatggaacactcaaacaacatctaaaaaagctaacccaagaaacccgccttgcatggcctgctctgttgcctatagccatattaagaatccaaaactctccccaaaaagtgggacttagcccatacaaactgctgtatggacagcccttcctaaccaatgaccctgtgcttgaccaagagatggccgacttagttgcagacatcacctccttagccaaatatcaacaagttcttaaaacactgcagggaaccagccgggcgcagtggctcatgcctgtaatcccagcactttgggaggccgagacgggtggatcacctgagatcaggagttcgagaccagcctggccaacatggtgaaacctcatctctacttaaaatacaaaaaattagctgggtgtggtggtacgcacctgtaatcctaggtattcgggaggctgaggcaggagaatcacttgaacccgggaggtggaggttgccgtgagccgagatcgtgccactgcatgccagactgggggacaagagcgagacatcatctcaaaaacaaacaaacaaaccaaaaaaaccacacattacagggaacctgtcccggagaggagggaaaggaattattccaccctggtgacatggtattggtcaagtcccttccctctaattccccatccctagatacatcctggaaaggacgctacccagtcattttatctaccccaaccgtggttaaagtggctggattggaatcttggatacatcacactcgagtcaaaccctggatagtgccagaggaacccgaaaatccaggagacattgctagctattcctgtgaacctctagaggatctgcgcctgctcttcaagagacaaccgtgaggaaagtaactagaatcgtagatccccatggccctcccttctcatatttttctctttactgttctcttaccccctttcactctcactgcaccttatccatgccactgtactgtcagaagctccccttaccaagagcttctatgaacaatgtagcttcccagaaatattgacgccccatcgtataggattttttctaaaggaaaccccactttcaccgcccacacccgtatgccccacaactgctataactctgctactctttgcatgcatgcaaatactcattattggagagggaaaataattaatcctagttgtcctggagggtttggagccactgtctgttggacttacttcacccatactggtatgtctgatgggagtggagttcaagatcaggcaagagaaaaacacgtaaaggaagtaatctcccagctgacgcaggtacatagatagcacccctatcccctacaaaggactagacctctcaaagctacatgaaaccctccatacccatactcacctggtaagcctatttaataccaccctcattgggctccatgaagccttggcccaaaaccctactaactgttggatgtgcctccccctgcactcaggccatatatttcaatccctgtatctttaacctccttgttaagtttgtctcttccagaatcgaagctgtaaaactacaaatggttcttcaaatggagccccagatgcaatccgtgactaagatctaccacagacccctggaccggcctcctagcctatgctctgatgttgatgacatcaaaggcaaccatcccaaggaaatatcaactgcacgacccctgctacaccccaattcagcatgaagcagttagagtggtcatcggccaacctccccaacagcacttgggttttcctgttgagaggggggactgagagataggactagctggatttcctaggccgacttagaattcttaagcctagctggggatggtgactgcacccacctttaaacacggggcttgtaactcagctcacacccgaccaatcaggtagtaaagagagctcactaaaataccaattaggctaaaggcaggaggtaaagaaatagtcaatcatctatcacctgagagcatagggggagggacaatgaccgggatataagccaggcatttgagccagcagtggcaaccccctttgggtcccctcccattgtatgggagctctgttttcactctattaaatctttttttaaatttattattattattatacttaaagttttagggtacatgtgcacaatgtgcaggttagttacatatgtatacatgtgccatgctggtgtgctgcacccattaactcgtcatttagcattaggtatatctcctaatgctatccctcccccctcccccaaccccacaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttcctattgtgaatagtgccacagtaaacatacgtgtgcatgtgtctttatagcagcatgatttatagtcctctgggtatatacccagtaatgggatggctgggtcaaatggtatttctagttctagatccctgaggaatccactctattaaatcttgcaactgcgcactcttctggtccgtgtttcttccggctcaagctgagctttcgctcacagtccaccactgctgattgccgccgttgcagacccgccgctgacttctagccgtccggatccggcagggtgtctgctgtgcttctgatccagcgaggcacccactgctgctctggatggggctagaggctcgccattgttcctgcgtggctaagtgcccgggttcgtcctaatcgagctgaacactagtcgcgggggtccacggttctcttccgtgacccatggcttctaatagagctataacactcaccgcatggcccaaggttccattccttggaatccgtgaggctgagaaccccaggtcagagaacaaaaggcttgccgccatcttgggagtggcccgtcgccatcttgggagctctaagaacaaacacctgctggtaacact

SEQ ID NO: 662 - DNA, 177 bp, Homo sapiens
ccacttgagtctcttccaaatgtacttacctttctttcccattctaaagccatttaaaataaacttccactcctgctctgaaacttcccttggtctctttttctgccttatgccctgtggttctttcttctgtggaggcaagaattgaggttgctgcagacccgtacagatttgtca

SEQ ID NO: 663 - DNA, 450 bp, Homo sapiens
gtcaggcctctgaacccaagccaagccatcgcatcccctgtgacttgcacgtatacacccagatggcctgaagtaactgaagaatcacaaaagaagtgaaaatgccctgccccgcctttactgatgacattccaccacaaaagaaatgtaaatggccggtccttgccttaagtgatgacattaccttgtgaaagtccttttcctggctcatcctggctcaaaaagctcccccactgagcaccttgcgacccccacttctgcccgccagagaacaaagccccgttgactgtaattttcctttacctgcccaaatcttataaaacggccccacccctatctcccttcgctgactcttttcagactcagcccgcctgcacccaggtgaaataaacagccatgttgctcacacaaagcctgtttggtgatctcttcacagggacgtgcatgaaa

SEQ ID NO: 664 - DNA, 5659 bp, Homo sapiens
gtcaggcctctgagcccaagctaagccatcatatcccctgtgacctgcacgtacacatccagatggccggttcctgccttaactgatgacattccaccacaaaagaagtgaaaatggcctgttcctgccttaactgatgacactgtcttgtgaaattccttctcctggctcatcctggctcaaaagctccaccactgagtaccttgtgacccccactcctgcccgccagagaacccccctttttcctttacctacccaaatcctataaaacggccccacaccatctcccttcactgactctcttttcggactcagctcgcctatacccaggtgattaaaagctttattgctcacacaaaacctgtttggtggtctgttcacatggacgttcatgaaatttggtgccatgactcggatcaggggacctcccttgggagatcaatcccctgtcctcctgttctttgctccgtgaaaaagatccacctatgacctcaggtcctcagacccaccagcccaaggaacatctcaccaattttaaattgggtaagcggcctctttgtactctcttctccaacctccctcactatccttcaacctccttcacctttcaatcttggcgccacacttcaatctctcccttcttttaatttcaattcctttggttttctggtagagacaaaggagacacgttttatccgtggacccaaaactccagcgccggtcaccaactgggaaggcagccttcccttggtgtttaatcatttcagggacgcctctgtgattattcacccacgtttcagaggtgtcagaccacgcagggacacctgccttggtccttcacccttagcggcaagtcctgcttttctgtggaaggggcaagtaccccaaccccttctctccatgtctctaccccttctccgcctttcttgggggccagaaagccccaaccccttctccttcacccttagcggcaagtcccacttttctgggggaggggcaaataccgcaacctcgtatctctgtgcccctatcccttatttccgtgccccaacctcttatatctctgcaccccgatcccttatttccgcgccccaacctcttatatctccatgccccaatcccttatttctgcaccctgacctcctttctctgtgccccggcccctttcccgcttttctggagggtaagaacccccaaaccccttccctccctgtctctactctctcttttctctgggcttgcctccttcactatgggtaaacttccaccctccattcctccttcttctcccttagcctgtgttcttaagaacttaaaacttcttcaactctcacctgacctaaaatctaagcatcttattttcttctgcaatgctgcttgaccccaataaaaactcgacagtagttccaaatagccagaaaatggcactttcaatttttccatcctgcaagatctaaataattattgtcgtaaaatgggcaaacggtctgaggtgcctgacgtcccggcatcttttacacattggtccctccctagtctctgtgcccagggcaactcgtcccaaatcttccttctttccctcccgcctgtcccctcagtcccaaccccaagcgtatctgagtctttctaatcttccttttctacagacccatatgacctctcccctcctccccaggctgctcctcgccaggccaagctaggtcctaattcttcctcagcctcagctcctccaccctatgatctttttgtcacctcccctcctcactcccggtccggttcataatttcattccgtgagtaggcctccctcacctgcccagcaatttcctcttaaaaaggtggctgaagctaaaggcatagtcaaggttaatgctcctttttctttatcagacctctcccaaatcagtgagcatttaggctctttcatcaaatatgaaaaacccagcccaattcatggctcattcggcagcaaccctgagacgctttacagccctagaccctaaaaggtcaaaaggccatcttattctcaatatacatttcattacccaatctgctcccaacattaaataaaactccaaaaattaaattccagccctccaaccccacacaggatttaattatcttgccttcagggtgtacaataatagaaaaaagttgcaattccttgcctccactgtgagacaaaccgcagccacatctccagcacacaagaacttccaaatgcctgaacctcagtgaccaggcgttcctccagaacctcctcccccaggagcttgctacaagtgccagaaatctgaccaccaggccaaggaatgcctgcagcccaggattcctcctaagccatgtcccatctgtgcaggaccccactggaaatcggactgttcaactcacctggcagccacttccagagtccctggaactctggcccaaggctctctgactgactccttcccagatcttcttggcttagcagctgaagactgacactgcctgattgcctcagaagcctacaggaccatcacagatgctctaggtaactctcacagtggaaggtaagtccatccccttcttaatacggaggctactcactccacattaccttattttcaagggcctgtttcccttgcttccataactattgtgtgtattgacggccaggcttctaaaccgcttaaaattccccaactctggtgccaatttagacaatactcttttaagcactcctttttagttatccccacctgcccatttcccttatcaggccgagacactttaactaaattatctgcttccctgaccattcctaggctacagccacacatcattgctgccttttcccccagttcaaagccttctttacatcctccccttgtatctccctatcttaacccacaagtataagacacctctactccctccttagcgacagatcatgcaccccttaccatcccattaaaacctaatcactcttaccccgctcaatgccaatatcccatctcacagcatgctttgaaaggattaaagcctgttatcactggcctgttacagcatggccttttaaatcctataaactcttcttaccattcccccattttacctgtcctaaaaccagacaaggcttataggttagttcagaatctgccccttatcaaccaaattgttttgcctatccaccccgtggtgccaaacccatatactctcctatcctcaatacctcccttcacaacccattattctgttctagatctcaaacatgctttctttactattcctttgcacccttcatcccagcctctcttcgctttcacttggactgaccctgacacccattaggctcagcaagttacctgggctgtactgccacaaatcttcgcagatagcccccattacttcagtcaagcccaaatttcatcctcatctgttacctatctcggcataattctcataaaaacacacgtgctctccctgctgatagcgtccgattaatctcccaaacctcaatcccttacaaaacaacaactcctttccttcctaggcatggttagtgcagtcagaattcttacacaagagccaggaccacaccctgtagcctttctgtccaaacaacttgaccttactgttttagcctagccctcatgtctgcgtgcagcggctgccgctgctttaatacttttagaggccctaaaaatcacacactatgctcaactcactctctacgtttctcataacttccaaaatctattttcttcctcatacctgatgcatatactttctgctccccagctccttcagctgtactcactctttgttaagtcgcacaattaccattgttcctggcccggacttcaatccggcctcccacattattctggataacacacctgaccctcatgactgtatctctctgatccacctgacattcaccccatttccccatattttcctctttcctgtacctcaccctgatcatgcttgatttattgatggcagttccaccaggcctaatagccacacaccagcaaaggcaggcttatgctatagtacaagccactagcccgcctcttagaacctctcattttctttccatcctggaaatctatcctcaagaaaataacttctcagtgttccatctgctattctactactcctcagggattattcaggccccctcccttccccacacatcaagctcgaggatttgcccccacccaggactggcaaattagctttactcaacatgccctgagtcaggaaactaaaatacctcttagtctaggtagatactttcactggataggtagaggcctttcctacagggtctgagaaggccactgcagtcatttattccgttctgtcagacataattcctcagtttagccttcccacctctatacagtctgataacagacgagcctttattagttaaatcagccaagcagtttttcaggctcttagtattcagtgaaacctttatatcccttacggtcctccgtcttcaagaaaagtagaatggactaaaggtcttttaaaaacacacctcaccaagctcagccaccaacttaaaaaggactggacaatacttttaccactttcgcttctcagaattcaggcctgtcctcggactgctacaaggtatagcccatttgagctcctttttgttaggccccagtctcattccagacaccagaccaacttggactgtgccccagaaaacttgtcatccctactatcttctgtctagcctagtcatactcctattcactgttctcaactattcatacatgccctgctcttgtttacgctgccagtttacactgtttctccaagccagcacagctgatatctcctggtgctatccccaaaccgccactcttaactcttaaagtaaataaataatctttactggcaaggctatgccgaacctccttaggcactctgtaattagatgtcctaggtcctcccaattcttagtcctttaatacctgtttttctccttctcttattccgtttagtttttcaattcatacaaaactgtatccaggccatcaccaataattctaaatgacaaatgttacttctaacaaccccacaatatcacctcttaccacaaaatcttccttcagcttaatctctcccgctctaggttcccatgccacccctaatcccgctggaagcagccctgagaaacatcgcccattctctctccataccacccccaaaaatttccaccgtcccaacactttaccactgtttcattttatttttcttattaatataagaagacaggaatgtcaggcctctgagcccaagctaagccatcatatcccctgtgccctgccttaactgatgacattccaccacaaaagaagtgaaaacggcctgttcctgccttaactgatgacattgtcttgtgaaattccttctcctggttcatcctggctcaaaagctcccccactgagtaccttgtgacccccactcctgcccaccagagaacaacccccctttttcctttacctacccaaatcctataaaacagcccaaccccatctcccttatctgactctcttttcggactcagccctcctgcactcaggtgattaaaactttattgctcacacaaagcctgtttggtggtgtcttcacacggacacgaatgaaa

SEQ ID NO: 665 - DNA, 8094 bp, Homo sapiens
gtcaggcctctgagcccaagctaagccatcatatccccagggacctgcacgtatacatccagatggcctgaagcaactgaagatccacaaaggaagtgaaaatagccttaactgatgacattccaccattgtgatttgtttctgccccatcctaactgatcaatgtactttgtaatctctcccacccttaagaaggttcttcgtaattctttgtaatcccacccttgagaatgtactttgtgagatccaccccctgcctgcaaaacattgctcctaactccaccgcctatcccaaacctacaagaactaatgataatcccaccacactttgctgactctctttttggactcagcccgcctgcacccaggtgaaataaacagccttgttgctcacacaaagcctgtttggtggtctcttcacacggatgcgtgtgacgtgcgtgacatttggtaccaaagatccgggacgggagtactccttacagagaccggtcccctgtcctcatcctcactccatgaggagatccacgtacaacctcgggttctcagaccaaccagcccaaggaacatctcatgaatttcaaatcgggtaagtggtcttttcactctcttctccagcctctctcgctacccttcagtctccctgtccttccaattccagttctttttcctctctagtagagacaaaggagacatattttatccgtggacccaaaactccggcgccagtcacggactcggcaagacagtcttcccctggtgtttaatgactgcagggacgcctgcctgattattcacccacactccactggtgtctaatcactgtggggatgcctgccttggtcattcacccacattcccttggtggcaagtcaattgcggggacaacctgctttggctgctcacccacattgcagcccacggctgctccctaccccccttctccgtgtctctacccttctctttaaactggcctccttcactgtgggcaacctttcaccctccattcctccttcttctcccttagcctgtgttctcaagaacttaaaacctcttcaactctcacttgacctaaaatctaagcatcttattttcttctgcaacaccgcttggccccagtacgaactcgacaatggttctaaatggccagaaaatggcacttttgatttctccatcctgcaagacctagataatttttgtcgaaaaatgggcaaatagtctgaggtgccttacgtccaggcatttttcagacttcgttccctccctagtctctgttcccactgtgactcatcccaaatcctcctcctttccctcccgcctgtcccttcagtcccaacctcgagcgttgctgagtcttgtgaatcttccttttctgctgacccatctgacccctcacctcctccccaggctgctcctcctcagctcgctccccgccaggctgatcaggctccagctcttcttcagcctctgctccccaccctataacccttctattacctccctcccacacccggtccggtttacagtttctttctgcgaccagctctcccccatctgcccaacaatttcctcatagagaggtggctggagctgaaggcatatgtcagggtacatgtgcctttttctctatcagacctttcccaaatcagccagcgtttaggctctttctcatcagaccccactaaatacatacaggaattccgatatctaactctgtcctacagtttaacctggagtgactgaaatgtcatcctaacttctaccctctccccagataaatgggaaagagttttttctctagcccaatctcacactgacaaccaccggcttcacgagccagacctccaggagggcatcagagcagttccccgagaagatccccagtggaactaccaggcagattccccaggtatagctacgcgagattacatggtttcctgcctagttgaagggcttaaaaaggcagcttacaaagctgttaattatgacaaacaagaaactacccgaggtgaagatgaaaacccagcccagttcatggcccacttggcagtaacccttagacgctttaccgccctagacccagaggggccaggaggccgccttattcttaatatgcattttatcacccagtcagctcctgatgttagaaaaaagattcaaaaactggaatccagccctcataccccacaacaggaattaatcaacctcaccttcaaggtgtacaataataggaggtagccagacagcaacgcatttctgagttacagctactcgcctctgctgtaagacagcccacaaccacgtctccagcatacaagaacttcagaacatccaagccacagctcccaggggctccttcaaaacatcctcgtgggccttgcttcaaatgccaaaagcctggccactgggccaaggaatgcccgcagcctgggattcctcctaagctgtgccctgtctgtgcgcgcccccactggaggtcggactgtccgactcacatcgccgctgctcctaaagcacctggagcccaaacccaacgttccttggccaactccttcccagatctcctcggcttagtggctgaagactgacgctgcccatcgcctcgggagcccctggaccatcacagacactttgggtaactcttacagtggaggataagtctgtccctttcttaatcaatacagaggctacccactccacattaacctttttttcaagggcctgtttcccttgcctccgtaactgttgtgggtattggcggccaggcttctaaacctcttaaattccccaactctggtgccaacttggacaacattcttttatgcacccctttttagttatccccacctgcccagatcccttactagattgagacattttaactaaattatctgcttccctgactattcctagcctacaaccacacctcattgccacccttttctccagttcaaagccgccttcacaccctccccttggatctccccaccttaatccacaagtataggacacctctactcccaccttggcaaccaatcatgcaccccttaccatcccattaaaacctaatcactcttaccccactcaatgccaatatcccatcccacagcacactttaaaaggattaaagcctgttatcactcgcctgttatagcatggccttttaaaacccataaacactccttataattcccccattttacctgttccaaaaactggacaagccttacaggttaatttcagaatctgcaccttatcaaccaaattgtcttgcctatccaccctgtggcgccaaagccatatactcttctatcctcaatacctccctccagaacccctctacatatattattatgtagatatgtacatatctacatatgtacataatctacataacccattctgttctggatctcaaacatgctttctttactattcctttgcacccttcatcccagcctctcttcattttcacttggactgacccggacacccatcaggctcagcaaattacctgggctgtactgccacaaggcttcacggacagccccccccccccccgttacttcagtcaagcccaaatttcttcctcatcctttacctatctcgacttaattcttcatgaaaacacagtgctctccctgctgatcgtgtctagctaatctcccaaaccccgaccccttctacaaagcaacagctcctttccttcctaggcatggttagatactccgcctttggatacctagctttaccatcctgactaaaccatcatataaactcacaaaagcaaacccagctgaccccacagatcctaaatcctttcgccactcctctttccgttccctgaaaacagccctagaagctgctcccacactagctctccctaactcatcccaacactttttcattacatacagccaaagtgcagggttgtgcagtcagaattcttacacaagagccaggaacggcccctgcagcccttctgtccaaacaacttgaccttactgttttaggctagcccccacattattcctgataccacacctgaccccccatgactgtatctctctaatccacctagcatttactcaatttccccatatttccttctttcctgttcctcaccctgatcacacttggtttattgatggcagttccaccaggcctaatcgccactcaccagcaaaggcaggctatgctatagtaacttccacacctatcattgaggctaccactctgcccccctccactacctctcagcaagccaaactcattgccttaactcaagccctcactcttgcagaaggagtacgtgtcaatatttatactgactctatgccttccatagagtcagcatgcaccaccatgctgttatatgggcagagagaggtttcctcactatgtaagggtcctccatcattaatgcctctttaataaaaattcttctcaaggtcgctttacttccaaaggaatctggagtcatttactgcaagagccatcaaaaggcatcagatcccatcattcagggcaacacttatgctgataagttagctaaagaagcagcttagttttccaacttctgtccctcacggccagtttttctccttctcatcggtcactcctacctactctcccactgaaacttccacctatcaatctcttcccacacaatgtaaatggttcttagacaaaggaaaatatctccttccagcctcacaggcccattctattctatcatcatttcacaacctcttccatgtaggttacaagccgctagcctgtctcttagaacctctcatttcctttccatcgtggaaatctatcctcaaggaaatcacttctcagtgttccatctgctattctactactcctcaaggattgttcaggccccctccctccctacacatcaagcgcggggatttgcccctgcccaggaccggcaaattgactttactcacaggccccgagtcaggaaactaaaatacctcttggtctggatagatgctttcactggatgcgtagaggcctttcccacagggtctgggaaggccaccgcagtcatttcttctcttctgtcagacataattcctcggtttggccttcccacctctatacagtctgataacggaccggcctttattagtcaaatcacccaagcagtttctcaggctcttggtattcagtggaaccttcatatcccttaccatctcaatcttcaggaaaggtagaagggactaatggtcttttacagacacacctcaccaagctcagcctccagcttaaaaaggactggacagtacttctacctcttgcccttctcagaattagagcctgtcctcaagaagctacacggtacagtccatttaaacttttatgtggacgcactttcttgctcagccccaacctcatcccagacaccagccctctaggcaactatcttccagtctttcagcaggctagacaggaaattcgccaggctgctaatcttctcttgcctactccagattcccagccacatgaagacaccctagctggatggtcagttcttgttaataatctgacccctcaaactctacaacctcgatggaccggaccctacttaaacatctatagtacccccaaccaccatctgcctgcagaaccctccccactgggttcaccgttccagaataaagctgtgtccgtcagacagccagtccgatatctcctcttcctcctggaagtcgcaagtactctcccctacttcccttaaactcactcgcatttctgaagaacaataacccttatgagcctaatacatcccttcattctattaggtctatccatccttaccctactcttcgcaacagggctttacgcagtcacccccactacttggactgtgccccaaaaacctgtcatccctactatcttctgtctagtcatactcctattcaccattctcaactactcataaatgacctgctcttgtttacactgccagtttacattgtttctccaagacatcacagctgatatctcctggtgatatccccaaaccgccactcttgactcctgcttggagtggatagatgatctttggtggcagggcaccctccaacacttccaccctgatgaagttctattctttacttttatattcactcttattctcattcccattcttatgccactctctacctctccccagttacctccagcatactatcaatctcacccactctctcctcactgcctccaatccttttctagcaaagaattgttggctacgcgtttccctttcctcctgcttttacacagccatccctgctctacaggctgactgggctacctctcccgtctccctgcaactcagaacctcctttaataaccctcatctttacccgcctgaggaacttctttattttctagacagatttggtgagaactccccagacatttcacaccaacgagctgccacacttctccgcatctacttacggcatctttctccttatgtcaattccactcctcccatatttggaccccaaccacacaaacaactatccctgttgccgtttctttatgcatctcccgacaacagcctgctggaatccctttaggcaaccttccaccgtccaaatgttcctttactctttgtctccagaacccagccacacacattaccaaacagatgggagcattccaacttcgcattactgacaagccctctatcattattgacaaactaaaaaacattggcagtcactattgtttaggaagacacctaccctgcatctcaccccatccttggctaccaccctcccctgctcgtctgaatctcctcctagcccctcctcttgcttgcttataccctgccccatgaatagcagcgaaaggttacttgtagacactatgcgctttctcatacaccatgaaaaccaaacccctccctctacgcagttgcaccatcaatccccattacaacctctaacggctgctgcccttgctggatcgctaggattctggatgcaggattcctctttcagtacaccctctcaccttttcactttacatttccagttctgcctgacacaaggtctcttctttttatgtggctcttccacctacatgtgcctacctgccaaatggatgggcacatgtactctagtcttccttacctccaaaatccagtttgcagatgggaacgaacaactgcctgtccccctcatgacatcaacacaacaaaaaagagtcatcccactaatccctttacttattggtctaggactttctgcctccagtattgcacttggaactggaatagcaggcatctcaacctctgtcacaacagtccgcagcctctctaatgacttctctgctagcactacagatagatcacaaactttatctgttctccaagcccaggttaactctttagctgcagttgtcctccagaacggccaaggccgcgatttactcactgctgaaaaaggaggactctgtatatttttaaatgaagagtgttgtttttacctaaatcaatctggcctgctatatgacaacataaaaaaactcaaggatagagcccaaaagctcgccaaccaagcaaacaataacattgaacccccttggacactctctaattggacgtcctgggtactcccaattcttagtcctttaatacctatttttctccttcttttattcggaccttgtgtctttcgtttagtttctcaattcatataaaaccgcatccaggccatcatcagtaattctatatgacaaatgctccttctaacaaccccaaaatctttcttcagttgaatctctcccactgtaggttcccacaccgcccctgatcccgctcgaagcagccttgagaaacatcgcccattatctctccataccacccccaaaatttgtcactgctccaacacttcaccactattttgttttgcttttcttattaatataagaagacaggaatgtcagccctctgagcccaagctaagccatcatatcccgtgacctgcatatacatccagatggcctgaagcaactgaagatccacaaaggaagtgaaaatagccttaactgatgacattccaccat

SEQ ID NO: 666 - DNA, 925 bp, Homo sapiens
gtggggaaaagaaagatcagattgttactgtgtctgtgtagaaagaagtagacataggggactccattttgttctgtaatctataaccttacccccaaccctgtgctccctgaaacatgtggtgtgtcaactcaggattaaatggattaagggctgtgcaagatgtgctttgttaaacaaatgcttgaaggcagcaagctcgttaagagtcatcaccactccctaatctcaagtacccagggaaagaaagcactgcagaaggctgcagggacctctgcctaggaaagccaggtattgtccaaggtttctccccatgtgatagtctgaaatatggcctcgtgggaagggaaagacctgacctttccccagcccaacacccgtaaagggtctgtgctgaggaggattagtaaaagaggaaggaacgcctctttgcagttgagacaggaggaaggtatctgtctcctgcccgtccctgggcaatggaatgtctcgatataaaacccgattgtatattccacctactgagataggggaaaaccgccttagggcggaggtggaacatgcgggcagcaatactgctctttaaggcattgagatgtttatgtgtatacatatctaaagcacagcacttaattctttaccttgtttatgatgcagagaactttgttcatgtgtttatctgctgaccctctctccactattatcctatgatcctgccacatccccctctccgaggaacacccaataatgatcaataaatactaagggaactcagaggctggcgtggatcctctgtgtgctgaacgccggtctcctgggcccttttttctttctctatactttgtctctgtgtctctttcttttccaagtctctcgttccacctaacgagaaaaacccacaggtgtggaggggcaacccacctct

SEQ ID NO: 667 - DNA, 486 bp, Homo sapiens
agaccactactactcctgctgccctcctccccccaccttgcctagtttacaagacaggaggaaagagagaaagcaaaaagttagaaaacaaaacaaaacagaagtaagataaatagccagaagaccttggcgacaccacccggccctggtagttaaaaaaaagtaacaataataataatatcaacccctgacctaaactacttgtgttatctgtaaattccagacattgtatgaaaaagcattgcaaaactttctgctctgttagctgatgcgtgtagcccccagtcacgttccccgcttgcttgagatatcatgaccctttcacgtggaccccttagagttgtaagcctttaaaaaggccaagaatttctttttcagggatctcagctattaagatgcaagtctgccaatgctcctggccaaataaacctcttccttctttaatccggtgcctgaggagttttgtctgtggctcgtcctgctaca

SEQ ID NO: 668 - DNA, 989 bp, Homo sapiens
gtggggaaaagaaagaaagatcagtttgttactgtgtctatgtagaaaaggaagacgtaagaaactccattttgatctgtactaagaaaaattgttctgctttgagatgctgttaatctgtaactttagccccaaccctgtgctcacagaaacatgtgctgtattgattcaaggtttaatggatttaggtctgtgcagaatgtgccttgttaacaatatgtttgcaggcagtatgcctggtaaaagtcatcgccattctccattctcgattaaccacggacacaatgcactgcagaaagccgcagggacctctgcccaagaaagcctgggtattgtccaaggtttccccccactgagacagcctgagatatggcctcgtgggaaaggaaaaaccttacatcctccagcccaacacctgtgaagggtctgtgctgaggaggagtagtgaaagagggaggcctctttgcagttgagataagaggaaggtttctatctcctgctcgtccctgggaatggaatgtcggggtgtaaagccaaccattcgttctattctgagataggagaaaaccgccccgtggctggaggtgagatatgctggcagcaatactgctctgttactctttgctacagtgagatgtttgtgtaaagtgaaacataaatctagcctctgtgcacatccagacatagtacctttccttgaacgtattcatgatacagattcctttgctcacatttttccctgctgaccttctccccaccatcaccctgttgccctgccacactcccctcgccaagatagtaaaaatagtgatcaataaatactaagggaaatcagagaccagcgctggtgtgggtcctcacacgttgagcgccggtctcctgggcccactgttctttctctgtactttgtgtctgtgtcttatttcttttctcagtctctcgtctccacctgacgagaaatacccacaggtatggaggggcaggccccc

SEQ ID NO: 669 - DNA, 980 bp, Homo sapiens
gtggggtaaagaaagagagatcggattgttactgtgtctttgtagaaaaggaagatataaggaactccattttgatctgtactaagaaaaattgtttctgctttgagatgctgttaacctgtaactttagtcccaaccctgtgctcacagaaacatgtgctgtattgaatcaaagttcaatggatttagggctgtgcgggctgtgccttgttaacaatatgtttgcacggcatatgcttagtaaaagtcatcgccatcctccattctcgattaaccagggacacaatgcactgcggaaagccgcaggaacctctgcccaagaaagcctgggaattgtccaaggtttcccccaactgagacagcctgagatatggcctcgtgggaaaggaaagaccttaccatcccccagcccgacaccagtaaagggtctgtgctgaggaggaggagtgaaagagggaggcctctttgcagttgagataagaggaaggcttctgcctcctgctcgtccctgggaatggaatgtctcggtggaaagctgacgattcccattcgttctgttctgagataggagaaaaccgccctgtggctggaggcgagatatgctggcagcaacactgctgtgttactctttgctacactgagatgtttgggtaaagagaaacataaatccagcctacgtgcacatccaggcacagtacctttccttgaacttattcgtgatacagattcctttgcttacgtttccctgctgaccatctccccacctgttgccctgctacactcccctcgctaaaatagtaaaaataatgatcaataaatactgagggaactcagaggctggtgccgctgtgggtcctccgtatgctgagcgccggtccccttagcccactgttctttctctgtagtttgtctctgtgtcttatttcttttctcagtccctcgtcccacctgacgagaaatacccacaggtgtgaaggggc

SEQ ID NO: 670 - DNA, 975 bp, Homo sapiens
aggtagctagtcaggcataagcagggcaggaggggctccctgctatacccctgccatacgtataccacgaatgtcaggtgaccatcaggtgatggtcaggcaattgttaactggctctttaaaataataattggtcacagccaacaccaggaaaaggaagaatacccaaaactggtcatcaacagctttctgataagatcccaggaattgggcaagttggctcaagcatgcacattaagaggcaaaatggcggagtttaactggtatatgaccttcctctaggaatgctagactggcaagggaagaacacctcaagtgagcatgtgtacaacttcagtaaacacactgcacatgctcttcttccaagcgctagcaggccactgcacatgcggacagcttaccccaaggaaagaatcaggggagaggtaaactgcaagaccccagaaatatgcaatgtataaaaccccaaggtggccaggcacggtggctcatgcatgtaatcccagcactttgggaggctgaggcgggtggatcacctgagatgaggagttcgagatcagcctggctaacatatgaaaccctatctctactaaaaacacaaaactaagttgggcgtggtggtgggtgcctgtaatcccagctactcaggaggctaaggcaggagagttccttgaacccgggaggcggaggtcgcagtgagccaacattgcaccattgcactccagcctgggtgacagagcaagactccatctcaaaacaaaacaaaacaaaaccccaagtcaaaagatcaaatggtgtgcttgatctctcgtctcctgcctggccctcttccacgtgtactttacttcctttcattcctgctgtaaagctttttaataaactttcactcctgctgtgaaacttgcctcagtctatccttctgttttatgcccctcagtagaattctttctttggaggaggcaagaattgaggttg

SEQ ID NO: 671 - DNA, 678 bp, Homo sapiens
ttagagtaggcagcttaagtcaggcatgagcagggcaggaggggcccttgcttgaccaggaatgtcatgagaccatcaggtgatggtcaggcggttgttaagctggctctctaaaataataattggttgcagctgacgccaggaaaaggccttctctcaataggtggaaaacctgaaactggtgacctgcttcctgaggagatctcaggagttgggcaaatgggctcaggcatgtgcactaaggggcaaaatggatgatgaccttcctctaggggcactggatgggtaaggggaaaatgcctcaagtgagcatgcgtacaactttagtaaacataccatgcccatgctcccctcccaatgctggcaggccactgtgcatgcagacaacccaccccaagggaagaatcggggagaagagatgcaagaccccagaagcatgccagtgaataaaactccaagccacaggtcaaacagtgcacttgatctctcaagtctcctgcttgatcctcttccaaatgtactttacttcctttcattcctgttctaaagctttttaataaactttcattcctgctctaaaacttgcctcagtctctcactctgccttatgccccttggtcaaattctttcttctgaggaggcaagaattaaggctactgcagacccatatggattcgc

SEQ ID NO: 672 - DNA, 406 bp, Homo sapiens
gtcaggcctccgagcccaagctaagccatcatatcccttgtgacctgcatgtatacatccagatggcctgaagtaactgaagaatcacaaaagaagtgaaaatggcctgttactgccttaactgatgacattaccttgtgaaattccttttcctggctcatcctggctcaaaagcttccccactgagcaccttgtgtcccccgcccctacctgccagagaacaaccccctttgactgaaattttcctttacctacccaaatcctataaaacagccccacccctatctgccttccctgactctgagtcccttccaggactcagcctgcctgcacccaggtgaaataaacagccttgttgctaacacaaagcctgtttggtggtctcttcacacggacaccagtgaaa

SEQ ID NO: 673 - DNA, 2143 bp, Homo sapiens
tacaacagaaattccctataattcccaaggacaggccatagttgaaagaactaatagaacactcaaaactcaattagttaaacagaaagaaggggaagacagtaaggagtgtaccactcctcagatgcaacttaatctagccctctatactttaaattttttaaacatttatagaaatcagactactacttctgcagaacaacatcttactaaaaagaagagcccatatgaaggaaaactgatttggtggaaagacaacaaaaataagacatgggaaatagggaaggtggtaacgtaagggagaggttttgcttgtgtttcaccaggagaaaatcagcttcctgtttggatacccactagacatttgaagttctacaatgaacccattggagatgcaaagaaaagcgcctccacggagacggagacactgcaatcaagcaccatcaactcacaagatgaacagaatggtgatgtcagaagaacagatgaagttgccatccaccaagaaggtggaggcgccgacttgggcacaattaaagaagctgacacagttaactaaaaaaaaaaaagcctagagaacacaaaggtgacacaaactccagagaacatgctgcttgcagctttgatgattgtatcaactgtggtaagtctccccatgcctgcaggagcagctgcagctaattatacctactgggcctatgtgcctttcccgcccttaattcaggcagtcacatggatggataatcctgatgggagataggctcatgagcctagaacatcgtttccagttacagtgtgactgggatacatcagatttttgtattacaccccgagtttataatgagtctgagcatcactgggacatggttagacgccatctgcagggaagagaagataatcccactttagacatttccaaattaaaagaacaaattttcgaagcatcaaaagcccatttaaatttggtaccaggaactgaggtaatcgcgggagttgctgatggcctcacaaatcttaaccctgtcacgtgggttaagaccatcggaagtactactattgtaaatttcatattaatccttccccagaggcaggccccagtctgcaggtgtacccagcagctccgaagagacagcgaccatcgagaacaagccatgatgacaatggtgtttttgtctaaaagaaaaggggaaaatgttgggaaaagaaagagagatcagactgttactgtgtctatgtagaaagaggtagacataacagactccattttgttctgtactaagaaaaattcttctgccttgagatgctgttaatctgtaaccctacccccaaccctgtgctcacagaaacatgtgctgtgtcgactcaaggtttaatggatttagggctatgcaggatgcactttgttaaacaaatgcttgaaggcagcatgcttgttaaaagtcatcaccactccctaatctcaagtacccagggacacaaaacactgcagaaggccacagtgacctctgcctaggaaagccaggtattgtccaagggttctccccatgtgatagtctgaaatatggcctcgtgggaagggaaagacctgagcgtcccccagcccgacacctgtaaagggtctgtgctgaggaggattagtaaaagaggaaggcctctttgcagttgagataagaggaagacatctgtctcctgctcctccctgggcaatggaatgtctcggtgtaaaacccgattgtatgttccatctactgagataggagaaaaccgccttaaggctggaggtgagacatgctggtggcaatactgctctttaatgcattgagatgtttatgtatgtgcacatcaaagctcagcacctttttcttaaccttatttatgatacagagacatttgttcacatgttttcctgctgaccctctccccactattaccctactgtcctgccacaaccccctctcagagatggtagagataatgatcaataaatactgagggaactcagagacccgtgccttcgcgggtcctctggagcaccagtcccctgggcccacttttccttctctatactttgtttctgtgtctctctcttttgtcagtccgatgagaaacacccacaggtgtggaggggcaggccaccccttca

SEQ ID NO: 674 - DNA, 1015 bp, Homo sapiens
cttttaaatctaataacttgatttgtctccttgctttcaggccatcaagctatagatgatcttcagtgagggataccctcctctcaatattcaagagtcacccttctacgggtgacccctagactgcccatcagtgagacatgacagaggtgaaattctgccccgtctcccttgggacctggctggataccactttcaccaacccacagagccaccctgctgtgacaactagcaagaggctaagacccacagaaccaccaccacccctctgtcagcaggaagtagttacagaagactgcccttcatccatttcccccaaagaattggggtcttgaactccagaggggggaaatattatagcagttagctagtcaggcatgagcagagcaggaaagggctccccgataacaggaatttcaggcgactatcaggtgatggtcaggcagctgtcacactgtctctctaaattaataactggttgtagctggtgccagaaaaaggcagtctccaaatagacagaacacctgaaacgtgatcagcagcctccctataagatctcaggagttgggtgagtgggatcaagcatgcacattaagaggcaaaatggcagagtttaactggtacatgaccttccagggacatcccactggcaagggaagaatgcctcaagtgagcatgtgtgcaactccagtaaatacactgcacatgtgaacagcccaccctaagggaataatcaggggaagaggaacacaagatcccagaagtctgccaacatataaaaccccaagtcaaaaggtcaaactgcacacttatctttcaagtcgtctgcttggcccttttccaagtatactttccttccttttgttcctgctctaaagcttcttaataaactttcactcctgctctaaaacttgcctcagtgtctcctgccttcagcacctcagctgaattctttcttctgaggagaactgaggttgctgcagacccatatggattcgctactggtaacaatact

SEQ ID NO: 675 - DNA, 1107 bp, Homo sapiens
ttacagtgggtagctagttgggtatgagtggggcagaagagagctccgccccttcccccaccccccacaatacaccaggagtgtcaggcaaccatcaggtgatggtcaggtggtcaactgtctctctaaactaataactggtcacagccagtgccaaggaaaggcagtctctcctaataaatagaaaacacctgaaactggtgatcagcagcttcctgataagagctcaggagtttggcaactggggagaagtaacataaaaccccagaagtatgccagtgtataaaaccccaagtcaaaaggtcaagccacgcacttgcgtcttgagtcacctacttggccctcttccaagtgtactttccttccttttattcctgttataaaacttttatttatttatttattttttgggagatggagtctcactctgtcacccaggctggagtgcaatggcatgatcttggctgtctgcaacctctgcctcctgggttcaagcgattctcctgcctcagcctcctgagtagctgggactacaagtgacctccaccacgtctggctaatttttgtatttttttttttttttttttgagacggagttttgctcgttgcccaggctggagtgcaatgacgcgatctcagctcactgcaacctctgcctcccgggttcaagcgattctcctgccttagcttttctgagtagctgcgattacgggcgtgcaccaccacgcccggctaattttgtatttttagtagagacggagtttctccatgctggtcaggctggtctcgaactcccgacctcaggtgatctgcccacctcggcctcttagtgttgggattacaggcatgagccaccacacctggccttaattgttgtatttttagtagagatggggtttcatcatgttggccaggctggtctcaaattcctgacctcaggtgatccacctgcctgagcctcctaaagtgttgggattacaggcgtgagccactgggcctggcccttgttataagacttcttaataaaactttcactcttgctctaaaacttgcctcagtctctccttctgccttatgcccctcaaattctttcctctgaggaggcaa

SEQ ID NO: 676 - DNA, 5849 bp, Homo sapiens
gtcaggcctctgagcccaagctaagccatcatatcccctgtgacctgcacatatacatccagatggcctgaagtaactgaagaatcacaaaagaagtgaaatttaaatggcctgttcctgccttaactgatgacattccaccacaaaagaagtgaaaatgtccggtccttgccttaactgatgacattaccttgtgaaattccttctcctggctcatcctggctcaaaaacctcccccactgagcaccttgtgacccccactcctgcccgccagagaacaacccccctttgactgtaattttcctttacctacccaaatcttataaaacagccccacctcatctccctttgccgactcttttcggactcagcccgcctgcacccaggtgattaaaaagctttatttctcacacaaagcctgtttggtggtcacttcacacagacgcgagtgaaatttggtgctgtgactcggatcgggggaccgcccttaggagatcagtcccctgtcctcctgctctttgtttcatgagaaagatccacctacgatctccagtcctcagaccaaccagcccaaggaacatctcaccaattttaaatccggtaagcagcctctttttattctcttctccaacctctcactatccctcaacctctttctcctttcaatcttggtgccacacttcaatctctcccttctcttaatttcagttcctttccttttctagtagagacaaaggagacatgttttatccatggacccaaaactctggcgccggtcacagactcaggaagacagtcttcccttgttgtttaatcacgcggggacacctgcctgaatattcaccgacgtttcagaggtgtctgaccacgcggggacgcctgccttggtccttcacccttagtggcaagtacctcttttctagggggcaagaatgccccctgaccccttatctccacgtctctaccccttttctgcttttctggagggcaagaactccccaaccccttctctccatgtctctaccccttttccgcttttctggagggcaagaactccccaaccccttctctccgtgtctctactctctcttttttctgggcttgtctccttcactatgggcaaccttccagcctccattcctccctcttctcccttagcccgtgttctcaagaacttaaaacctcttcaactcacacctgacctaaaacataaacgccttattttcttctacaatgccgcttgaccccagtacaaacttgacagtggttccaaatagccagaaaacggcactttcgatttttccatcctaccagatctagataattcttgtcgtaaaatgggcaaacggtctgagatgcctgaagtccaggcattcttttacacattgttcactccctactctctgttcccaatgcgacttgtcccaaatcctcctttccctctcgcctgtcctctcagtcccaaccccaagtgttgctgagtctttctaatcttccttttctacagacccatctgacctctcacctcctccccaggctgcccctcgccaggcggagccaggtcccaattcttcctcagcctctgctcccccaccctataatccttttatcacccgccctcctcacaccctgtccggcttacagtttccttccgtgactagccctccccaacctgcccagcaatttcctcttaaaaaggtggcttgagctaaaggcatagtcaaggttaatgctttttctttatgcgacctctcccaaatcagttagtgtttaggctgtttcatcaaatatgaaaaacccagcccagttcatggctcgttcggcagcaaccctgagatgctttacagccctagaccctaaacgtcaaaaggccgtcttattctcaatatacattttattacccaatctgctcctgacattaaataaaactccaaaaattaaattctggccctcaaaccccacaacaggacttaattaacctcgccttcaaggtgtacaataatagagtagaggcagccaagtagcaaccaacatatttctgagttgcaattccttgcctccactgtgagacaaaccccagccacgtctccagcacacaagaacttccaaatgcctaacccgcagtggccaggcattcctccaggcctgcctcccccaggagcttgctacaagtgcgggaaatctggccactgggccaaggaatgcccacagcctgggattcctcctaagtcgtgtcccatctatgcaggaccccactaaaaatcagactgttcaactcacctggcagccacttccagagcccctggaactctggcccaagtctctctgactccttcccagatcttctcggcttagcagctgaagactgacaccacctgatcacctcggaagcctacaagaccatcacagacactctgggtaactctcacagtggagggtaagtctgtccccttcttcatcaatacggaggctacccactccacattaccttcttttcaagggcctgtttcccttgcctccataactgttgtgggtattgacagccaggcttctaaaccagttaaaactccctaactctggtgccaacttagacaatactcttttaagcactcctttttagttatcccacctgcccagttcccttattaggccaagatattttaactaaatcatctgcttccctgactaatcctgggctacagccgcacctcattgccactttttcccccagttcaaagcctccttcacatcctccccttatatctccccaccttaacccgcaagtataagatacctctactccctccttagcgaccaagaatccaccccttaccatctcattaaaacctgatcacccttaccccgctcaatgccagtatcccatcccacagcacgctttgaaaggatcaaagcctgttatcacttgcctgctacagcatggccttttaaagcctataaactccccttacaattcccccatttcacctgtgctaaaaccagacaaggcttataggttagttcaagatctgcaccttatcaaccaaattgttttgcctatccaccccgtggtgccaaacccatatactctcctatcctcaatacctccctccacaacccattattctgttctggatctcaaacatgctttctttactattcctttgaacccttcatcccagcctctcttcgctttcacttggactgaccctgacacccatcaggctcagcaaattacctgggctgtactgccgcaaggcttcacagacagcccccattacttcagtcaagcccaaatttctttctcatctgttacctatcttggtgtaattctcataaaaacacacgtgctctccctgctgatcgtgtccaactgatctctcaaaccccaacacctacaaaaaaacaactcctttccctcctatgcatggttggatactttcaactttagatacatggttttgccatcctaacaaaaccattatataaactcacaaaaggaaacctagctgagcccatagatcctaaatcctttccccactgctctttccattccttgaagacagctttagagactgcccccactctagctctccctgacttatcccaacccttttcattacccacagctaaagtgcagggctgtgcagtcggaattcttacacaagaaccaggaccgcaccctgtagcctttttatccaaacaacttgaccttactgttttgcctagccctcaagtctgcatgcagcggctgccactgccctaatgcttttagaggcccttaaaatcacaaactatgctcaactcactctctacagttctcctaacttccaaaatctattttcttcctcacacctgacacatatactgtctgctgactggctccttcagctgtactcactctttgttgagtctcccacaattaccattgttcctggcccggacttcaatccggccttccactttattcctgataccacacctgacccccatgactgtatctctctgatccacctgacattcaccccatttccccatatttccttctttcctgttcctcaccctgatcacacttggtttattgatggcagttccaccaggcctaatcgccacacaccagcaaaggcaggctatgctatggtacaagccactagcccgcctcttagaacctctcatttcctttccatcgtggaaatctatcctcaaggatataacttctcagtgttccatctgctattctactactcctcagggattattcaggccccctcccttccctacacatcaagctcagggatttgccccgctcccaggactggcaaattggctttactcaacatgccccgagtcagaaaactaaaatacctcttagtctgggtagacactttcactggatgggtagaggcctttcctacagggtctgagaaggccaccacagtcatctcttcccttctgtcagacataattccttggtttggccttcccacctctatacagtctgataacggaccagcctttattagttaaatcagccaagcattttttcaggctcttggtattcagtgaaacttttatatcccttacggtcctcagtcttcaggaaaggtagaacggattaatgttcttttaaaaacacacctcaccaagctcagccactaacttaaaaaggactggacaatacttttaccactttcccttctcagaattcaggcctgtcttcggaatgctacagggtacagcccatttgagctcctgtatggatgctcccttttattaggccccagtctcattccagacaccagaccaacttggactgtgccccagaaaacttgtcatccctactatcttctatctagtcgtactcctattcacctttctcaactactcatacatgccctgctcttgtttacactgccagtttacactgtttctctaagccatcacagctgatatctcctggtgctatccccaaactgccactcttaactcttaaagtaaataaataatctctgctggcaaggctatgctgaacctccttaggcactctctaattagatgtcctaggtcctcccaattcttagtcctttaatacccatttttctcctcttattctgtttagtttttcaattcatacaaaaccgtatccagtccatcaccaataattctacacgacaaatgtttcttctaacaaccccacaatatcaccccttaccacaaaatcttccttcagcttaatctctcccactctaggttcccatgccgcccctaatcccactcgaagcagccctgagaaacatcgcccggtatctctccataccacccccaaaattttcgccgccccaacactttaacactgttttgttttatttttcttattaatataagaagacaggaatgtcaggcctctgagcccaagctaagccatcatatcccctgtgacctgcacatatacatccagatggcccgaagtaactgaagaatcacaaaagaagtgaaatttaaatggcctgttcctgccttaactgatgacattccaccacaaaagaagtgaaaatgtccggtccttgccttaactgatgacattaccttgtgaaattccttcttctggctcatcctggctcaaaaacttcccccactgagcaccttgtgacccccactcctgcccgccagagaacaacccccctttgactgtaattttcctttacctacccaaatcttataaaacagccccaccccatctcccttcgctgactctcttttcggactcagcccacctgcacccaggtgattaaaaagctttattgttcacacaaagcctgtttggtggtctcttcacacagatgcgagtgaaa

SEQ ID NO: 677 - DNA, 3601 bp, Homo sapiens
ctgtacagtctccaacgggcattatttttcaaaatacagaccttgtgcggtggtcattccttcctcacagtataattaagacttttacattgtatttagatgaaatggctgcattaattggtcaggcaagactatgaatagtaaaatcgtgtggaagtgacccagatgaaatcattgttcctttaaacaaggaacaggttagacaagccgttgtcaattctggtgcatgacagattggtcttaccgattttgtgggaattattgataatcactacccaaaaacaaaaatcttccatttttaaaaattgactacttggattttacctaaaattaccagacataaacttttagaaaatgctctgacggtgtttactgatggttccagcaatggaaaagtggcttacacaggccaaaagaatgagtcattgaaactcaatgtcactcagctcaaagagcagagttggttgctgttatttcagtgttacaagattttaatcagcctattaacattgtttcagattctgcatatgtagtacaagctaaaaaggatgttgagacagccctaatcaaatatagcatggatgatcacttaaaccagctgtttaatttattacaacaaactgtaagaaaaagaaatttcccattttatattactcatattagagcacatactaatttaccagggcctttaaagcaaatgaacaagctgactcgctagtatcatctgcattcataaaagcacaagaacttcatgctttgactcatgtaaatgcatcaggactaaaaaataaatttgatatcacatggaaacaggcaaaaaatattgtacaacattgcattcagtgtcaagtcctacacctgcccactcaggaggaaggacttaatcccagaagtctaagtcctaatgctttatggcaaatggatgtcacatatgtacctcatttggaaaattgtcatttgtccatgtgacagttgatacttattcacatgttgtatgggaaacctgccagaaaggagaaagtacttcccatgttaaaagacatttattatcttgttttgctctcatgggagtatcagaaaaaattaaaacggataatgggccaagatactgtagtaaagcatttcaaaacttcttaaatcagtggaaaattacacataaaacaggaatcccttatgattcccaagggcaggccataattgaaagaactaatagaacactcaaagctcaattggttaaataaaaaaaaggaaaaagagagtagaagtgtaacacttcccagatgcaacttaatctatctagcacactatactttaaattttttaaacatttatagaaatcagaccactacttctgcagaacaacattttactggtaaaaagaacagaccacatgagggaaaactgaattggtggaaagacatgaaaaataagacatgggaaataggtaagatgataacatgagggagaggttttgcttgtgtttcaccaggagaaaatcagcttcctgtttggatacccacaaggcatttaaaattctacaatgaacccatcggagatgcaaaaaaagtgcctccacagagacagaaaacctgcaatcgagcatcatctactcgccaggtgaataaaatggtgatatcagaagaacagaggaagttgccatccaccaagaaagcggagccaccgacctgggcccaactaaaaaagctgacacagttagctgaaaaaagcctgaagaacacaagggtaacacaaactccagagaatatgctgcttgcagctttaatgattgtatcaacggtggtaagtctccctatgtctgcaggagcagctgcagctaattacacttactgggcctatgtgcctttcccgcccttaattcgggcagtcgtttggatagataatcctattgaagtatatgctaataatagtgcatgagtgccaggccccacagatgaccgtggccctgcccaacctgaggaagaaggaatgatgataaacatttccattgggtatcattttcctatttgcctggggaaggcaccaggattcttaatgcctacaacccaaaattgattggtagaagtacctactgtcagtgccaccagtaaatttacttatcacatggtaagtggaatgtcacttgggtcacaaataaataatttatagcactcttcttattaaagatcattaaaatttaggcctcagggaaaaccttgccccaaggaaattcgcaaagaatcaaaagacccagaagtcttagttcaggaagaatgtgtggctgatactgcgatggtattacaaaacaataaatttggaactattatagactgggccccttgaggccaattatattatgattgtacaggccagactcactcatgttcacaggccccatctgtctggcccactaatctggcctatgatagtgatttaactgaaaggctagaccaggtttatagaaggttagaatcaccctatccatggaaatggggtgaaaagggaatttcatcacctcgaccacagttagttactcctgttactggtcccgaacatccagaattatggaagcttactgtggcctcacaccacattagaatttgatctggaaatcaagttatgggaacaagaaatcataagccatattatactattaacttaaattcctttgcaaagttgtggaaaacccccttatatgctagttgtaggtaacatagttattaaaccagattcctaaactataacctgtgaaaattacagattgtttacttgcattgattcaacttttgattggcagcaccgtattctgctagtgagggcaagagagggcgtgtggattcctgtgtccatggactgaacgtgggaggcttccccatctgtccatatgttaacagaagtattaaaaggagttctaactagatccaaacgattcatttttactttgattgcaatgattatgggccttattgcagtcgcagctactgctgtggctgctgtaattgctttacactcctgtcttcaaactgcagaatatgtcaataattggcaaaagaattcttcaaaattgtggaattctcagacccaaatagataaaaaaattggcaaaccaagttaatgatcttagacaaactgtcatttggatgggagattgacttgtgactggaatatgtcagatttttgtattaaacctcgagcctgtaatgaatctgaatatcactgggacacggttagacaccatctacaaggaagagaagataatattaccttagatatttcaaaattaaaagaacaaatttttgaggcatcaaaatcccagttaaatctggtgccagaaactgaggaaatggtgaaagctgctgatagcctcacaaatcttaaccccgtcacttgggttaaaaccattggaagttccactattgcaaattttgtattaatccttgtgggtctgttctctctgttgttagtctacaggtgtatccagcagttccagagagacagcgaccagtgagaatgggccatgatgacgatggtggttttgtcaaaaagaaaaaggggatatgtagggaaaagaaagagagatcagactgttactgtgtctatgtag

SEQ ID NO: 678 - DNA, 6694 bp, Homo sapiens
gtaggagatcagtcagggtggtgggaaaaattgtagaaagatgtaaaccttcttggaaggctggaaggttttacaaaagcttcggaaaaagatttggctgaaggcagccagattgtcttatctggtgcctgaaactttaggttaggtaacaaggggatgtaaagaaactcatctaagtaagttagtttacttagaccatggaacctggcctaaatcatctgcatgcaagactagcggggggtgggggtgggcgcagcacgaccatgtgaattccccacaagtgtgttgactcaagacctttgtcattaaatctatactgaataaatgcccgcagcgcaagcacaggcttgtcagggcctcagccgctgactctttatacaccctcctcagtgtctgtgggcggcccagtcccctagcccactctttcactggcttcctgtgtctgagttcatttgttcatctgttgttcagccagggtctgcgggtcggacccggaaggtagagccctgtgtgaggaatgctgcaacagatcacaacagaacccttgaaaatgaaggtgaaaaaactgcggtcagtaagtcactgttgcctgctctgaatttccaagttcgagggaattgctcaggctagggtttcatcaagggacaacagttatcagctcaacagaaacagtatataaaagtatttaaaaagctgcttaaagctagtggagcctgggtttcacaggctcaattaagggacctaatgcaaactgttgtatcccataacccatggttcctggaagaaggtacactagccatagagctctaggaacaagtggggagaaatcttaaacatcatgcacaaggacaacaggtcccagtaacatctttaacattatgggctttagttagggcagctctggccccgttatacacagaagagcctaaaaaggggagggaggaggaaccatcatctaccttactgcctccttatccctcagccccgctatcaccgggccaaaataacaaagaggaaacggaggttttgcctgagccccctcctccaataaactagaagaaaagacaagggatatgctacagctgggggaccctgtcttaagcaagtggcattagaaggggagctcttagcctgcccagtaatgcaagaacgacaatgcaatcaggtacatgaacccatttcttttaatgcttataaaaagctaagaaaaagcattaaagaaaacagagccgctagcccatttccttacgaaaggaatgactgaagccttggcagacaacttccgtatgaccccatgggactggtcagtgctagctaaaacaattttggaggccagccagtacctcctctagagggcagaatacgatgagttgtgcgaacaacaagccaaccagaacgaggtggccgtgcaagatgtaacagctgctatgctccaggggaggcgtccccatgccgatgtacaacaactaattttgatccccaggcctatgcacaagtgtctttgtgcgctctcggggcttgggacagaatttccaaaagcagagatcaacagggatcttttataaatgttcgacaagggcctcaggagccatttgttgaatttatcaatcgtttaacccaggcaattaagagacaaattagtcacacccaggactgatatcttgttacaattggcttataaaaacgctaatgtggatcgccaacaagcaatgcatgcaatcagaggaaaggcagccacagtcagggaacttacacaagcatgtcaactggtggggactgaaacacacaaagccaaaatattggctatggcattaaggcctcctaaagtgaaaagggagggaaacccaaattgttttctatgtggagaggcaggtcatatgaagagggaatgtcccaataatagagaccaaggtaactcaggaaaagaacccccttctatatgactgcaatgtaaaaaggggaaacattgggcaaatcaatgcaagtccaaatttgataaaaacgacaactccgtaagtaaccaggcgggaaacttcatgaggggctgaccccaggccctgctgcaaactggggcaatgtcagtggctttcctctgtcagatggaaagcccacagtcctctctctcagagcaaccaccactgggagcgcaagactggacttactctgccccgatgaattagtgctaaaagaaggagaagacactaaaagggttgcaaccgggatctggggcccactgcctctgggaacagtgggattagtcctagggcaatctagcctatccagtaaaggaatcaatgtgctcactggggtaactgatagtgattattgaggtgagatactagttatgatggaatgtaaaggtctgcatatttcttcccccgggatcaaagacagctctgttactgcttttaccatactgggtccccaatgcccagaaagggggaaagggacgttttggaagcacaggagccacaaaagtacactggaatcaattaatcactaaccagagacccatgatcaccttaaaaattggaaataagaattttactggcttattggacacacggatggatatttcaaacattaatgatcaaaactagccagaaacttgtccttgggtcactcagaaacaaaaaattgttggcattggggaagcgcacacagccaagcagagcacgtgccccctaacctgttgcgattcagaggtaagaaaggcagttatacaacctcaactcatgcccttccctgttaacctttggggacgggacctattagcccaatgggggggtcactctgcagacctctttctaataatggccacagttattcctcccctacccttgacattgctctctcaaaatcctatttgggtagaatagtgatctttaaagggaaagaaattacaaacagcccgtgaattagttgaggggcaactaaaagccagccatacagaaccatcaaacagcccctggaattcacccattttcgtcattcccaaaaggtctggtaaatggagacttttgcacgacttatgtgctatcaatgctaatttgcaacctatggggccccttcagcaggggctcccctcccccacggccattcgacattggcctataatcgttactgacttaaaagactgcttttatactattcccctagcagaagaggacagagaagaatttgcatttacaataccagcaatcaataatgaaaggccagctccctgattccaatggaaagtgcttccccaaggaatgctgaacagtcctaccatgtgtcagtatcatgtaaatcaggctttctccccagtagaaaagaatttcctaatggcaagattattcattttatggatgatattttactagcagccccaacagagccagtgattttaaggttatataactctgtagcaaagaatacacagttaagaggtttaatcatagcacctgaaaaagtacagatgtcttctccttggaaatatcttggatacagactaatttcttgctaagacctcaaaagcttaaattagatactagcaacttacacaccttaaatgattatcagaaattactaggtgatattaactggctttgccccaccctaggcataactactgataagttacaaaacttgttttctatcttaaaaggcaatgctgccctagactctcctaggtatttaactcctacggcacaaagggaaattgaagaagtagagcaatttatctctcaaaggcaattagatcgcacagatccatgatattcagttcagctgtttgtttttcccactaaacactcccctacagggttaacaagacagatgggcccagagctatgctttctagaatgggttttttgctcacataccgggactaaaacactctctctctatgtccagtgagtcaataaagtcatctattcaggcctcagacaatgcaatcagttgctaggttatgaccctgatatcatcaggattcctttaagtaaaaagcaatttgaagcagtattacccttatctatggacctgcaaacagcactctctgattacacaggccttatagggcatacccttcctgctgacaaactccttcagttcttatctcgtacttctgttgttttgcctactaaaatagttcaatcccccatacctaatgctttaacattgtttactaatggctctggtaaacatggaaaagcggctgtctggtggagatcacataattccctcactcattctggatttactagcactcagagagctgagattggagccttaatattagccttagaaactttctccactcagctcatcgatattgttagtgactctgcttactgtttatttattgcagaactttgagacggccttcattaagaccactctggagcccaccctgtgtgcactttttctccgacttcagcaactgctagatcaatgtatacatcttatttttattacacacattcgggcccacagctcactgcctggcccactggcttatggcaatgatcaagcagacctacaggttatgacatcactgcctgaccaagccacccaattgcaacaatttttccaccaaaacttgagaaacttatctaaacaatttcaacttacccagagactagctaaacaaattaccctacaatgcccagattgccagttcacaggcacatcccctccttcaacaggtgttaaccctagaggactagaacctaatcagttttggcaaacagatgttacacgcatccctgaatttggaaaacgtagatatgtacatgtatccattgataccaattctcatttaattagtactcatgctcttcctggagagtccacccgatatgtcattaaacatcttcttttaacttttgcatttatgggacggcccacagaaattaaaactgataatggtctggcttatgccagctcacaatttcaacaattttgtcacacatggaacatccaacattccacaggcatcccgtataactcccaaggacaggccatagaacgtacccaatccagccttaaaaatatgctcagaaaacaaaaaagggggaatatgaataaggaccctgcaacactactagcacaagccttatttacccttaatttttaaaatttaaataaatttcaatcagctgtagaaaagcactttgctaaaacctctcaagaaataaaacctgcagttttatggaaagacgtaaacagtaatgtatggtatggtccaaatgaattgttaacgtgggggagaggatatgcttgtgttcacaccccctcaggtcctctttgtattccagcataatgcatcgaaccataccatggtgtggctaggacccaacccagtaccagaaataaagaaaataaccctatgggacccatagccccgaacaatgtggcttcatcagacaacacaggccccggacaggatgctcaagaagacaagtcagaagactgagtgaatcctgctctggacacagacaccattcactccagataatctgctccttgttatgctttattattatttatttatttatttattttttttttgagacagagtctcactctgtcaccaagctggagtgcagtggtgcgatctgggctcactgcaacctctgcttgccaggttcaagtgattatcctgcctcagcctcccaagtagctgagaccacaggcacatgccaccatatccagctaatttttgtatttttagtagagatggggtttcaccatgttagccaagatggtctcaaactcttgacctcgtgatccacctgcctcagcctcccaaagtgctgggattaattctctcactctgcctgcaactagtacctgctacactctatttggcccatcctctaaatccgcctttcttctgccctgttacttagacaaatacccgaccttcccagcttctaacaacgtgactgcttggctgagagagattaacataaccccagtggggttccttagtaacagcacacaatgaactgaactgctgagtaacaatataggtcactccttgattggaaaaaaaaaaatgttgattatactcaagtttgtcttatgttatttactaatgctaggatgcaaagctggaatatgagcagttaccaccacgcctgacaaacctactgcacatatctgtactctcctatcaacaaaacctgatgctaaaaacagaaaagggagagatgtaggagatcagtcagggtgatgggaaaaactgtaggaagatgcaaaccttcttggaaggctgtaaggtttttacaaaagcttcggaaaaagatttggctgaaggcagccagattctcttatccggtgcctgacagtttaggttgataaaaagggaatgtaaagaaactgatctagataagtttacttagaccttggaacctggcctttaatcatccacgtgcaggactactggggtgggagggtgggaagggggggagcgcaaccatgtgaactgcccaccagtgtgttgactcaaggcctttgtcattaaatctatactgaataaatgccggcagcgcaggcttgtcagggccgcagctgctgactctttacagcaccctccttggtgtctgtgggtggcctggtcccctagcccgctctttcactggtttctggtgtctgagtgcacttgttcatccatcattcagccagggtctgcgggttggacccagca

SEQ ID NO: 679 - DNA, 799 bp, Homo sapiens
gagagacaggactagctggatttcctaggccgactatgaatccctaagcctagctgggaagatgaccacatccacctttaaacacggggtttgcaacttagctcacacctgaccaatcagggagtaaagagagctcactaaaatgctaattaggcaaaaacaggaggtaaagaaatagccaatcatctattgcctgagagcacagcaggagggacaatgatcaggatataaacccaggcattcgagccagcaatggctaccctctttgtgtcccctccctttgtatgggagctctgttttcactctatttcactctattaaatcttgcaactgcactcttctggtccgtgtttgttacggctcaagctgagctttcgctcaccatccaccactgttgtttgttgccgtggcagacccaccgctaactcccatccctccagatccagcagggtgtccgctgtgcttctgatcaagcaaggcgcccattgccactaccgatcgggctaaaggcttgccattgttcctgcacagctaagtgcctgggttcgtcctaatcaagctgaacactagtcactgggttccactattctattctgtgacccacggtttctaatagagcagtaacactcaccgcatggcccaagattccattccttggaatccgtggggccaagaaccccaggtcagagaacaggaggcttgccaccatcttggaagtggcccgacaccatcttggaagtggccgccaccatcttgggagctctgggagcaaggacccccaccccgccggtaacaattt

SEQ ID NO: 680 - DNA, 1129 bp, Homo sapiens
acccgggtcagagggactcctttgggagaccagtcccctgtcctcaccctcactccgtgaagagatccacctatgacctcgggtcctcagaccaaccagcccaaggaacatctcaccaatttcgagtaagcggtcttttcactctcttctccagcctctctcgctacccttcaatctccctgtccttccaattccagatcttttccctctctagtacagacaaaggagacacattttatctgtgtacccaaaactccggcaccggtcacagattcaggaagacagtcttcccttggtgtttaatcattgcagggatgcctgcctgattattcacccatattccactggtgtctgatcaccacagggactcctgccttggtcatttacccatattcccttggtggcaagtcaattgcagggatgcctgctttggctgctcacccacattgcagcccagggttgctccccaccggcttcgccatatctacccttctctttaaacttgcctccttcactatgggcaaacttccaccctccattcctccttcttctccttagcctgtgttctcaagaacttaaaacctcttcaactcttgcctgacctaaaatctaagcatcttattttcttctgcatcactgcttggccccagtacaaactcgacaatggttctaaatggccagaaaacggcacttttgatttctccatcctacgagacctagataatttttgtcgaaaaatgggcaaatagtctgagatgccctacgtccaggcatttttcacacttcgttccctccctagtctctgttcccaatgcaacttgtcccaaatcctccttctttccctcccacctgtcccttcagtcccaaccccaagcatcgctgagtcttgtgaatcttccttttctactgacccatctgacctctcacttccttcccagactgctcctcctcaagtcgctccctgccaggctgaatcaggctccaactcttcttcagcctctgctcccctaccctataacccttctattacctccctctccacacctggtctggtttacagtttctttctgcaactagctctcccccactgcccgacaatttcctcttagagagttggctggagctgaag

SEQ ID NO: 681 - DNA, 687 bp, Homo sapiens
gagtaggtagctaggcagacatgagcagggcagagagctcccccacacccagaatgtcaggtgaccatcaagtgatggtcaggtggttgttaaactatctccctaaaataactggtcgcagctggcagcagggaaaggcagtctcccagtagacagaaaacacctgaagctcgtgatcagccgcttcccattaagatctcaggagctgggcgagtgggcccaagcatgtgcatttagatgcaaaattgcagagtttaactggtatataaccttcctctaaaaatgttcaacttagcaagggggaaaatgcctcaaatgagcatgcgcacaacttgagtaaacacactgagcatatggcccctcgagtgctggcaggccactgcacatgtggacagcccaccccaaggaaaaatcaagggagaagaaactcaaaccccggaaccacgccagtgtataaaaccccaagtcaagggccaaacagaacacttgaatctctcaagttgcttgcttggccctcttccaagaatactttacatcctattgttcctgttctaaaactttttaataaactgtcactcctgctcaaaaacttgccttggtctctcactctgccttatgccccttagacaaattctttccttcaaggaggcaagaatcaagttgcttcagacctgtacggatccacca

SEQ ID NO: 682 - DNA, 983 bp, Homo sapiens
gtagggaaaagagagatcagactgttactgtgtctatgtagaaagggaagacaaaagaaactccattttgacctgtaccctgaacaattgctttgccttgagatgctgttaatctgtaactttgccccaatcttgagctcacagaaacatgtgttgtatggaatcaaggtttaagggatctagggctgtgcaagatgtgccttgttaacaaaatgtttacaggcaggcagtatgcttggtaaaagtcatcaccattctccagtctcgataaaccaggggcacaatgcactgcggaaagccgcagggacctctgccctggaaagccaggtattgtccaaggtttctccccatgtgatagtctgaaatatggccccgtgagatgggaaagacctgaccgtcccccagcccgacacccgtagggggtctgtgctgaggaggattagtaaaagaggaaagcctcttgcagtggagatacaggaaggccactgtctcctgcctgcccctgggaactgaatgtctcggtataaaacccaattgtacatttgtttaattctgggataggagaaaagccaccctgtggtgggaggtgagacatgttggcagcaatgctgctctgttactctttactctactgagatgtttgggtggagaaaagcataaatctggcctacgtgcacatctaggcatagtaccttcccttgaacttatttgtgacacagattcctttgctcacatgttttcttgctgaccttctccccactatcaccctgctgtcctgccacattgctcttgctgagacagtgaaaacagtaattaataaatactgagggaactcagagactggtgctggtgaaggtcctccgtatgctgagcgccggtcccctgggcccacttttctttctatatactttgtctctgtgtcttatttcttttctcagtctcttgtccagactgactagaaatacccacaggtgtggaggggc

SEQ ID NO: 683 - DNA, 951 bp, Homo sapiens
gtggggaaaagaaagagagatcagactgttactgtgtctatgtagagagaagtagacataagagactccattttgttctgtactaagaaaaattcttctgccttgggatgctgttaatctgtgaccttacccccaaccctgtgctccctgaaacatgtgctgtgtcaactcagggttaaatggattaagggcggtgcaagatgtgctttgttaaacagatgcttgaaggcagcatgctccttaagagtcatcaccactccctaatctcaagtacccaggggcacaaacactgcggaaggctgcagggacctctgcctacgaaagccaggtattgtccaaggtttctccccatgtgacagtctgaaatatggcctcctgggaagggaaagacctgaccgtcccccagcccgacacccgtaaagggtctgtgctgaggaggattagtaaaagaggaaggaatgcctctttgcagttgagataagaggaaggcatctgtctcctgctcgtccctgggcaatggaatgtctccgtgtaaaacccgattgtatattccatctactgagacaggggaaaaccgccttagggctggaggtgggacatgcgggcagcaatactgctctttaaggcattgagatgtttatgtatatgcacatcaaaagcacagcacttttttctctaacttgtttatgatgcagagacatttgttcacatgttttcctgcagaccctctccccactattaccctattgtcctgccacatcccgctctcccagaaatgcccgataatgatcgataaatactgagggaactcagaggctggtgccggcgcgggtcccctgcgcccacttttccttctctatactttgtctctgtgtatctttcttttctcaagtctctcgttccacccaacaagaaacgcccacaagtgtggaggggcaggccaccccttca

SEQ ID NO: 684 - DNA, 713 bp, Homo sapiens
tcaatccatcaagaccctttcacgtggaaccccttaaagctgtaagcccttaaacgggccaggaactctgtcttccttccgggagctcggctcttaagacgcgagtctgccgaagctcccagcggaataaaaaaaactcttccttctttaatccgctgtctgaggggttttgtccgctgctcatccatgctccatttctttgttccctgaccgggaatcgaacgcaggcagcagcggtgagagcaccgaatcctaagcactagaccaccaggggaacttagaaccttgtgggaaatagattgcgcaccattagaagtgggttggccatcagaaggaagcctggacaggtcccttgtttctaaggcgtggcacaaggtaactggtaaagatacctagaccagttcccatacatagacacttggtgacagctggtgctagaacccccacagtggctgagggcatgcagcagcaatactagtagcaaagggacagatagctaaggaaggatcccgctccactcacccagggaaatcaactcctgaagttctgttcgaccccacatcagaggatccattgcaggagatggcaccagagatcccagtggtgtcctccccttaacagggaaagaggctccccactcttgagcccacagtgcttgtgcctccacaagacaagcatatccctaggccacccagagtagacaagagaggagg

SEQ ID NO: 685 - DNA, 990 bp, Homo sapiens
aagaacacgtgagaaagtgtggggaaaagaaagagaaatcagattgttactgtgtctatgtagaaaaggaaacataagaaactccattttgatctgtattaagaaaaattgtttctgctttgagatgctgttaacttgtaactttatccccaaccctgtgctcacagaaacatgtgctgtattggatcaaagtttaatggatttaggactgtgcaggatgtgccttgttaatatgtttgcaggcagtatgcttggtaaaagtcatcgccattctccattctctgttaaccaaggacacaatgcactgtggaaagccacagggacctctgcccaagaaagcctgggtattgtccaacgtttcccccaactgagacagcctgagatatggcctcatgggaaaggaaagaccttaccatcccccagcccgacacccataaagggtctgtgctgaggaggaggagtgaaagagggaggcctctttgcagttgagataagaggaaggcttctctgctcatccctgggaatggaatgtctctgtgtaaagccgaccattcccattcattctattctgagataggagaaaaccgccctgtggctggaggcgagatatgctggcagcaatactgctctgttgctctttgctacactgagatacttgggtaaagagaaacataaatctagccttcgtgcacatccgggcacagtatctttccttgaacttactcatgatacagattcctttgctcacatgtttccctgctgaccttctccccacctgttgccctgctacactccccttgctaagatagtaaagatcatgatcaataaatactgagggaactcagaggctggcgccggtgcgggtccttcgtatgctgagcgccagtgccctgggcccactgttctttctctgtactttgtccctgtgtctatttcttttctcagtctctcatcccacctgacgagaaatacccacaggtgtgaaggggc

SEQ ID NO: 686 - DNA, 4222 bp, Homo sapiens
gaactagttgccttaattcaagccctcactcttgcaaaaggactacgtgtcaatatctatactgattctaaatatgcctttcatattctgcaccaccatgcggtcatatgggctgaaagaggtttcctcactacacaagtgtcctccatcattaatgcctctttaagaaaactctgctcaaggctgctttacttccaaaggaagctggggtcattcactgcaaggggcatcaaaagacttcagatcccattgctctaggcaatgcttatgctgataaggtggctagacaagcagctagctctccaacttttgtccctcatggccagtttttctccttcacatccgtcactcccacctactccacagctgaaacttccacctatcaagctcttcccccgcaaggtaaatggttcttagaccaaggaaaatatctccttccagcctcacaggcccattctattctgtcgtcatttcataaccttttccatgtaggttacaagccactagcctgtctcttaggacctctcatttcctttccatcatggaaatctatcctcaaggagatcacttctcagtgttccatctgctattctgctacccctcagggattgttcaggcctcctccctttcctacacataaagcttggggatttgcccctgcccaggactggcaaattgactttactcacatgcctcgggtcagaaaactaaaatatctcttagtctgggtagacactttcactgggtgggtagaggcctttcccatagagtctgagaaggccaccgcggtcatttcttcccttctgtcagacataattccttggtttggccttcccttctctatacagtctgataacggaccagcctttactagttaaatcacccaagcagtttctcaggctcttggtattcagtggaaccttcatatcccttaacatcctcaatcttcaggaaaggtaaaaccgactaatggtcttttaaagacacacctcaccaagctcagcctccaacttaaaaaggattggacagtacttttacctctcgcccttctcagaattagaacctgtcctcgagatgctacagggtacagtccatttgaacttttatatggacgcactttcttgcttggtcccaacctcatcccagacaccagccctctaggcgactatcttccagtcctccaacaggctaggcaggaaagtcaccaggctgctaatcttctcttgcctactccagatccccagccatatgaagacactctagctggacgatcagttcttgttaagaatctgacccctcaaactctacaacctcgatggactggaccctacttagtcatctatagtaccctgactgccgtccgcctgcaggatcctccccactgggttcaccattccagaataaagctgtgtccattggacagccagcctaatccctcctcttcctcctggaagtcgcaattactctcccctacttcccttaaactcactcgtatttctgaagaacagtaataacccttatgagcctaatacatcccttcattctattaggtctgtttgtccttgccctactttttgcaacagggctttatgaactcacccccaccacttaggctgagcccaaaaaatcttgtcatccctactattttctgtccagtcatactcctattctctgctctcaactacttataaatgccgtactcttgtttacactgctggtttacactgtttcttcaagccatcacagctgatatctcttggtgctatccccaaaccgccactcttaattccctcttagagtgggtagatgatctttgctggcagggcaccctccaatacttccaccctgatgaagttctattctttacttttatactctctcttattctcattcccattcttatgccaccttttgcctctccccagctatctccaccacactatcaaccttacccattctctcctagctgcttctaatccctccttagtgaacaactgctggctttgcatttccctttcttccagtgcctacatagctgtccctgccttacagacagactgggctacatctcctgtctccttacacctctgaacttcctttaacagccctcacctttaccctcctaaggaactcatttactttctagacaggtccagcaagactttcccagacatttcacatcagcaagctgccgccctcctccgcacttatttaaaaaacctttctccttatattaactctactccccccatatttggacctctcacaacacaaactattattcctgttgctgctcctttatgtatctcttggcaaagacccactggaattcccctaggtaatatttcaccttcttgatgttcctttactctttatctccaaagcccaactacacacatcactgaaacaattggagccttccagctccatattacagacaagccctctgtcaatactgacaaactcaaaaacattagcagtaattgttgcttaggaagacacttaccctgtatttcactccatccttggctaccttccccttgctcatcagactctcctcccaggccctcttcttgtttacttatacccagcccccaaaataacagtgaaaggttgctcatagataatcaacgttttctcgtacatcatgaaaattgaacatcctcctctatgcagttaccccatcagtccccattacaacctctgacagctgccgccctagctggatccctaggagtctgggtacaagacacccctttcagcactccttttcacttttttactttacatctccagttttgcctcacacaaggtctcttcttcctctgtggatcctctacctacatgtgtctacctgctaattggacaggcacatgcacactagttttccttacccccaaaattcaatttgccagtgggactgaagagctccctgttcccctcatgacaccgacatgacaaaaaagggttattccactaatttccttgatggttggtttaggactttctgcctccactgttgctctcggtactggaatagcagtcatttcaacctctgtcacgaccttccgtagcctgtctaatgacttctctgctagcatcacagatgtgccacaaactttatcagtcctccaggctaaagttgactctttagctgcagttgtcctccaaaaccgctgaggccttgacttactcactgctgaaaaaggaggactgtgtatattcttaaatgaagactgttgtttttacctaaaacaacctggcctggtgtatgacaacataaaaaaactcaaggaaagagaccaaaaacttgccaaccaagcaagtaattacgctgaatccccttgggcactctctaattgcatgtcctgggtcctcccaattcttagtcctttaatacccatttttctccttcttttattcggaccttgtatcttccatttagtttctcaattcatccaaaactgtatccaggccatcaccaatcattttatacgacaaatgtttcttctaacaaccccacaatatcaccccttaccacaagatctcccttcagcttaatctctcccactctaggttcccatgccacccctaataccgcttgaagcagccctgagaaacatcacccattctctctctccataccaccccccaaaaattttcactgccccaacacttcaacactattttatttttcttattaatataagaaggcaggaatgtcaggcctttgagcccaaatcaagccatcgcatcccctgtgacttgcatgtatacgcccagatggcctgaagtaactgaagaatcacaaaagaagtgaatatgccctgccctgccttaaatgatgacattccacaacaaaagaagtgtaaatggccggtccttgccttaactgatgatattccaccacaaaagaagtgaaaatggcccgtccttgccttaagtgatgacatcaccttgtgaaagtccttttcctggctcattctggctcaaaaactcccccactgagcaccttgtgacccccactctgcccaccagagaacaactccactttgactgtaattttcctttacctactcaaatcttataaaatggccccacccctatctccctttgctgactctctttttggactctgccggcctgcacccaggtgaaataaacaggcatgttgctcacacaaagcctgtttggtggtctcttcacacagacgtctatgaaa

SEQ ID NO: 687 - DNA, 3453 bp, Homo sapiens
gtcaggcctctgagcccaagctaagccatcatatgccctgtgacctgcacttacacatccagatggcctgaagcaactgaagaaccacaaaggaagtggttcctgccttaactgatgacattccaccattgtgatttgttcctgccccactgatcaattgaccttgtgacattccttctcctggacaatgagtctcatgacctccccaccctgcaccttgtgatccccgcccctgcccacaagagataaccatctttaactgtaattttccactatctacccaaatcctataaaactaccccacccctatctccctttgctgactcctttctcagactcagcccacttgcacccaggtgaataaacagccttgttactcacacagagcctgttggtggtctctcttcacatggactcgcatgacatttggtgccaaagacccgggacagggggactccctagggagaccggtcccctgtccttgccctcactccgtgaggagatccacctacaaccttgggtcctcagaccagcccaaggaacatctcaccaattttaaattgggtaagcagcctctttttattctcttctccaacctctcttgctatttctccacccttcaatctctcccttccttaatttggttcctttccctatttgttagagacagaggagacatgttttatccttgaactcaaaactctggcgccggtcacggactcaggaagacagtcttcccttggtgtctaatcactgtgaggatgcctgcctgattattcacccacatttcagaggtgtctgatcaccgcggggatgcctgccttaatctttcaccttggtggcaagtaccacctcccctgggtggcaagtaccaccccccaactctctctgtgtctctaccctctcttttctctaaacttacctttttactacgggcaaccttctgccctccattcctccttcttctcccttagcctgtgttctaaaaaacttaaaacctcttcaactcttgccggacctaaaacctaagcatcttattttcttctgcaaaaccgcttggccccaatacaaacttgacaatggttctgaatggccagaaaacagcatttttgatttctctatcctacaagatttagataatttttgtcaaaaaatgggcaaatggtctgtggtgcctgatgtccaggcattcttttacacatcggtccctccctagtctctgctcccaatgcgactcatctcaaatctttcttctttctctcctgtctgttcctttagtctccactccaagctctgagtcctttgaatcctccttttctatgaacccatctgacctttcccctcctccccaggctgctcctcaccaggccgagccaggtcccaattcttccttagccttcactctcctaccctataatccttctatcacctcacctcctcacacctggtccagcttacagtttcattccatgactagccctcccccacctgcccaacaatgtcctcttagagaggtggctggagctgaaggcatagtcaaggttagtgctcccctttctttagccgacctctcccaaatcagttagcgtttaggctccttttcatcaaataaaaaaacccagcccagtccatggcccgtttggcaacaacccttaacacttgactgccctagacccagaggggccgaaggccgtcttattctctctatatattttgttacccaatccactcccaaaattaggaaaagctccaaaaagtagattccggccctcaaactctacaagaggacttaattaaccttgtcttcaaggtgtacaataatagaaaagagatagccaagcagcaacttatttctgagttgcaattacttgcctctgctgtgagagaaatcccagccacatctccagcacaaaagaacttcaaaacacctagacctcagtggtcaagcattccttcagaacctcctctcccaggatcttgcttcaagtgctggaaatgtggccactgggccaagaaatgcccacagcctgggattcctcctaagccatgtcccatctgtgcggggccccactggaagtcagactgtccaaactcgcccggcagccactcccagagcccctggaactctggcccaaggctctctgactgactcctttctagatcttctcagcttagtggctgaagactgatgctgctcgattgccatggaaacctcctggaccatcacagatgctttggtaactcctacagtggagggtaagtccatccccttcttaatcaatatggaggctactcactccacattaccttcttttcaagggcctgtttcccttgcctccataactgttgtgggtattgacggccaggcttctaaacctcttaaaactctccaactttggtgccaacttgggcaacattcttttatgcactccctttttagttatccccacctgcccatttcccctattaggttgagatgttttaacaaaattatctgctaccctgactattcctggactacagccatatctcactgttgcccttctccccaactcaaagcctccttcacgtcttcctcttgtatccccccaacttaacccacaagtatgggacacctctactccctccctggcaactgatcacatgcccattactatcccattaaaacctaataatccttaccccgctcaatgtcagtatcccatcccacaacaggatttaaggggactaaagcctgttatcactcgcctgctacagcatgggcttctaaagcctataaactctccttacaactcccattttacctgtccaaaaaccggacaagtcttacaggttagttcaggatctgtgccttatgaaccaaattgttttgcctatccactctgtagtgcccaacccgtacactcttttgtcctcaataccttcctccacaactcactattccattcttgatcttaaagatgcttttttcactattcccctgcacccctcgtcccagcctctctttgcttttacctggactgacccggacacccatcagtcccagcagcttacctgggctgtactgccacaaggtttcagggacagccctcattacttcagccaagctctttctcatgatttactttctttccacccctctgcttctcactttattcaatatattgatgaccttctactttgtagcccctcctttgaatcttctcaacaagacaccctcctgctccttcaatatttattctccaagggatatcaggtatccccctccaaagctcaaatttcttctccatccattacctaccttgccataattcttcatgaaaacacacgtgctctccctggctgatctttcaaaccccaaccccttctacaaagcaacaactcctttccttcctgggcatggttggatacttttgcctttggatacctggttttgccatcctaacaaaacca

SEQ ID NO: 688 - DNA, 5742 bp, Homo sapiens
gtcaggcctctgagcccaagctaagccatcatatcccctgtgacctgcacgtacacatccagatggccagttcctgccttaactgatgacattccaccacaaaagaagtgaaaatggtctgttcctgccttaactgatgacattatcttgtgaaattccttctcctggttcatcctggctcaaaagctcccctactgagcgccttttgacccccacacctgctccccctttgactgtaattttcctttacctacccaaatcttataagacggccctatccctgtctcccttggctgactctcttttcggactcagcccgcctgcacccaggtgaaataaacagccttgttgctcacacaaagcctgtttggtggtctcttcacacaaacgcgcatgaaatttggtgccatgactcggatcggggtacctcccttgggagatcaatccccagtcctcctgctctttgctccgtgagaaagatctacctaggacctcaggtcctcagactgaccagcccaaggaacatctcaccaatttcaaatctggtaagtggcctctttttactctcttctccaacctccctcactatccctcaacctctttctcctttctatcttggcgccacacttcaatctctcccttctcttaatttcaattcctttcattttctggtagagacaaaggagacacattttatccgtggacccaaaactccggcgccagtcacggactcggggaggcagccttcccttggtgtttaataattgcgggggtgcctctctgattattcacccacgttccattggtgtctgatctctgcggggacgcctgcctttgatcattcacccacgttcccttggtggcaagtcaattgcagggactcctgctttggctgctcacctacgttgcagcccagggctgctccccaccccccttctccgtgtccctacccttctctttaaacttgcctccttcactatgggcaaccttccaccctccattcctccttcttctcccttagcctctgttcttaagaacttaaaacctcttcaactctcgcctgacctaaaatctaagtgtcttattttctgcaatgccatttgaccccaatacaaacttgacagtagttccaaacagccagaaaatggcactttgaatttttccattctacaaaatctaaataattcttgttgtaaaatgggcaaacggtctgaggtgcctgacgtccaggcattcttttacacatcagtccctctctagtctctgttcccagtgcaactcatctcaaatcttccttctttccctcccccctgtcccctcagtaccaaccccaagcgtcactgagtctttctaatcttccttctctacagacccatctgacctctcccctcctcaccaggccaagctaggtcccaattcttcctcagcctccgttcctccaccctataatccttttatcacctctcctcctcacacctggtcaggcttacactttccttctgtgactagccctcccccacctgcccagcaatttcctcttaaaaaggtggctggagctaaaggcatagtcaaggttaatgctcctttttctttatcccaaatcacatagcgtttaggctctttttcattaaatataaaaacccagcccagttcatggcttgtttggcagcaccctgagatgctttacagccctagaccctaaaaggtcaaaaggctgtcttattctcaatattcattttattacccaatccattcccgacattaaataaaactccaaaaattaagttccatccctcaaaccccacaacaggacttaattaaccttgccttcaaggtgtacaataatagagtagagacagccaatagcaacatatttctgagttgcacttccttgcctccactgtgagacaaaccccacccacatctccagcacacaagaacttccaaacgcctaaatcgcagtggccaggcattcctccaggcctgcctcccccaggggcttgctacaagtgccagaaatctggccatgaggccaaggaatgcccgcagcccgggattcgtcctaagctgcgtcccatctgtgcaggaccccactgaaaatcggactgttcaactcatctggcagccactcccagagcccctggaactctggcccaagcctctctgactgactccttcccagatcttctcggcttagcagctgaagactgacactgcccaatcgccttggaagccccctagaccatcacggatgccgagcttcgagtaactctcacagtggagggtaagtcctgtccccttcttaatcaatacggaggctacccactacacattactttcttttcaagggcctgtttcccttgcctccataactgttgtgggtattgatggccaggcttctaaacctcttaaaactccccaactctggtgccaacttagacaatacttttttaagccctcctttttagtcatccccacctgcccagttcccttattaggccgagacactttaactaaattatctgctgccctgactattcctgggctacagctatatctcattgccgcccttcttcccaatccaaagcctcctttgcgtcatcctcttgtatccccccaccttaacccacaagtataggatacctctactccctccttggcaaacgatcatgcaccccttaccatctcattaaaacctaatcacccttaccccgctcaaggccaatatcccatcccacagctcgctttaaaaagattaaagcctgttatcactcgcctgctacagcatggccttttagagcctataagctctccttacaattcccccattttacctgtcctaaaaccagacaagccttacaagttagttcaggatctgcgccttgtcaaccaaattgttttgcctatccaccccatggtgccaaacccatatacactcctatcctcaatacctccctccacaacccattattctgttctggatctcaaacattctttcgttactattcctttgcacccttcatcccagcctctcttcactttcacttggactgaccctgacacccatcaggctcagcaaatcacctgggctgtactaccacaaggcttcacagatagcccccactacttcagtcaagcccaaatttcatcctcatctgttacctatctcgggataattctcataaaaacacacgtgctctccctgctgatcgtgttcgactgatctcccaaacctcaatcccttctacaaaacaacaactcctttccttcctaggcatggttagtgcggtcagaattgttacataagagccaggacaacaccctgtagcctttctgtccaaacaacttgaccttactgttttagcctagccctcatgtctgtgtgcagtggctgctgctgctttaatacttttagagtccctaaaaatcacaaactatgctcaagtcactctctacagttcttataacttccaaaatctattttcttcctcatacctgatgcatatactttctgcttcccggctccttcagctatactcactctctgtcgagtctcccacaattaccattgttcctggcacgggcttcaatccggcctcccacattattctggataccacatctgaccctcatgactgtatctctctgatccacctgacattcaccccatttccccatatttccttatttcctgttcctcactctgatcacatttggtttattgatggcagttacaccaggcctaatcgccactcaccagcaaaggcaggctatgctatagtatcttccacatctatcattgaggctaccgctctgcccctctccactacctctcagcaagccgaactagttgacttaacccgggccctcactcttgcaaaacgactacgtgtcaatatttatactgactctaaatatgccttccatattctgcaccaccatgctgttacataggcagaaagaagtttcctcactatgcaagggtccttcatcattaatgcctcttaataaaaactctgctcaaggctgctttacttccaaaggaagctggagtcattcactgcaaaggccatcaaaaggcatcagatcccattgctctaggcaacgcttatgctgataaggtggctagacaagcagctagctttccaacttctgtccctcaacaagcagctagctttccaacttctgtccctcatggccaatttttctccttcacattggtcactcccacctgctcggggatttgcccctgcccaggactggcaaattgactttattcacatgccccgagtcagaaaactaaaatacctcttagtctaggtagacactttcactggataggtagaggcctttcctatagggtctgagaaggccactgctgtcatttcttcccttctgtcagacataattcctcggtttagacttcccacctctatacagtccgatagcagaccagcctttattagtcaaatcagccaagtattttttcaggctcttagtattcagtgaaacctttatatcccttacggtcctcagtcttcaggaaaggtagaacagactaatggtcttttacaaacacacctcaccaagctcagccaccaacttaaaaaagactggacaatacttttaccactttcccttctcagaattcaggcctgtcctcggaaagctacagggtacagcccatttgagctcctgtatagacactactttttattaggccccagtctcattccagactccagaccaacttggactgtgccccaaaaaacttgtcatccctactatcttctgtctagtcatactcctattcattgttctcaactacttacacatgccctgctcttgtttacactgccagtttacactgtttctccaagccatcacagctgatatctcctggtgctatccccaaactgccactcttaactcttaaagtaaataaataatctttgctggcaggactgtgctgaatctccttaggcactctctaaatagatgtcctaggtcttcccaattcttagacctttaatacctgtttttgtccttcttttattccgtttagtttttcaattcatacaaaaccatatccaggccatcaccaataattctaaatgacaaatgtttcttctaacaaccccacaatatcaccccttaccacaaaatcttccttcagcttaatctctcccactctaagtttccacactgcccataatcccgcttgaagcagccctgagaaacatggcccattatctctccataccacccccaaaaatttttgccgtcacaacattttaccactatttcgttttatttttcttattaatataagaagacaggaatgtcaggcctctgagcccaagctaagccatcatatcccctgtgacctgcacgtacacatccagatggccagttcctgccttaactgatgacattccaccacaaaagaagtgaaaatggcctgttcctgccttaactgatgacattatcttgtgaaattccttctcctggttcatcctggctcaaaagctcccctactgagcgccttgtgacccccacacctgcccctcctttgactgtaattttcctttacctacccaaatcttataaaatggccccacccctatctcccttggctgactctcttttcggactcagcccgcctgcacccaggtgaaataaacagccttgttgctcacacaaaccctgtttgctggtctcttcacaggaacgcgcatgaaa

SEQ ID NO: 689 - DNA, 4335 bp, Homo sapiens
gtcaggtctctgagcccaagccaagccatcccatcccctgtgacttgcacgtatacgccgagatggcctgaagtaactgaagaatcacaaaagaagtgaaaggccctgccccgccttaactgatgacattccaccattgtgatttgttcctgccccaccttaactgagtgactaaccctttgaatttccttctcctggctcagaagctcccccaccgagcaccttgtgacccccgcccctgcccaccagagaacaaccccctttgactgtaattttcctttaccttcccaaatcctataaaacggccccacccttatctcccttcactgactctcttttcggactcagcccaaccgcatccaggtgaaataaacagctttattgctcacacaaagcctgtttggtggtctcttcacatggacacacatgaaatttggtgccgtgacttggatcgggggacctcccttgggagatcaatcccccgtcctcctgctctttgctccgtgagaaagatccatctacgacctcaggtcctcagaccgaccagcccaagaaacatctcaccaatttcaaatccggtaagcggcctctttttactctcttctccaacttccttcactatccctcaacctctttctcctttcaatcttgacaccacacttcaatctctcccttctcttaatttcaattcctttcattttcggatagagacaaaggagacatgttttatccgtggacccaaaactccggtgccggtcacggactgggaaggcagccttcccttggtgtttaatcattgcagggatgcctctctgattattcacccacatttcaaaggtgtcagaccacgcagggatgcctgccttggtccttcacccttagccgcaagtcccgcttttctgggggaggggcaagtaccccaaccccttctctccatgtctctaccccttctctgcttttctgggggaggggcaagtacccctcaaccccttctccttcacccttagtggcaagtcccgcttttctagggggcaagaacccccaatcccttatttccgtgccccaaccctttctctgcttttctggagggcaagaaacccccatcacttctccgtgtctctactcttttctctgggcttgcctccttcactatggactagcttccaccttccattcctccttcttctcccttagcctgtattcttaagaacttaaaacctcttcaactctcacctgacctaaaatctaagcgtcttttttcttctgcaatgccgcttgaccccagtacaaactcgacagtagttacaaattgccagaaaaacggcactttcaatttttccatcctacaagacctaaataattcttgtcgtaaaacgggcaaatggtctgaggtgcctgatgtccaggcattcttttacacatcagtcccttcctagtctctgcccaatgcaattcatcccaaatcttccttctttccctcccgcctgtcccctcaggcccaaccccaagcgtcgctgagtctttctaatcttccttttctacagacccatctgacctctcccctcctcgccaggccgagctagttcccaattcttcctcagcctctgctcctccaccctataaactttttatcgcctcccctcctcacacctgatccggcttacagttttgttccatgactacccctcccccacctgcccagcaatttactcttaaaaaggtggctggagccaaaggcatagtcaaggttaatgctcctttttctttatcccaaatcagaagcgtttaggctctttttcatcaaatataaaaacccagcccagttcatggctcattcggcagcaaccctgagatgctttacagccctagaccctaaaaggtcaaaaggccatcttattctcaatatacattttattacccaatctgctcctgacattaaataaaactccaaaaattggaatctggccctcaaaccccataacaggacttaattaacctcactttcaaggtgtacagtaataaaacaaagttgcaattccttgcctccactgtgagacaaaccccagccacatctccagcacacaagaacttccaaacgcctgaacctcagtggccaggcattcctccagaacctcctcccccaggagcttgctacaagtgccagaaatctgaccaccaggccaagtaatgcccgcagcccaggattcctcctaagccgtgtcccatctgtgtgggaccccagtggaaatcggactgttcaactcacctggcagccactcccagagcccctggaactctggcccaaggctctctgactgactccttcttggcgtagcggctgaagactgatgctgcctgatcacctcagaagccccatagaccatcacggacgccgagctttaggtaactctcacagtggagggtaagtccgtccccttcttaatcaatatggaggctacccactccacattaccttcttttcaagggcctgtttcccttgcctccataactgttgtgggtattgacagccaggcttctaaacctcttaaaactccccaactctggtgccaacttagacaatactcttttatgcactcttttttagttatccccacctgcccagttcccttattaggccgagatattttaaccaaattatctgcttccctgactattcctggactacagccgcatctcattgctgcccttcttcccaatccaaagcctcctttgcatcctcttcttgtattcccccaccttaacccacaagtataagatacctctactccctccttggtgaccgatcatgcaccccttatcatctcattaaaacctaatcacccttaccccgctcagtgccaatatcccattacagcatgctttgaaaggattaaagcctgttatcactcgcctgctacagcatggccttttaaagcctataaactctccttacaattcccccattttacctgtcctaaaaccagacaagccttacaagttagctcaggatctatgccttatcaaccaaattattttgcctatccacctcatggtaccaaacccatatactctactatcctcaatacctccctccacaatccattattctgttctggatctcaaacatgctttctttactattcttttgcaccagtcatccaagcctctcttcgctttcacttggactgaccctgacacccatcaggctcagcaaattacctgggctgcactgccacaaggcttcacagacagaccccattacttcagtcaagcgcaaatttcatcctcatctgttacctatctcggcataattctcgtaaaaacacacatgctctccctgatgatcgtgtccgattaatctcccaaacctcaatcccttacaaaacaacaactcctttccttcctaggcatggttaatgtggtcagaattcttacacaagagccaggaccgcaccctgtagcctttctgtccaaacaacttgaccttactgttttagcctagccctcatgtccgcgtgcagcggctgccgctgctttagtacttttagaggccctcaaaatcacaaactatgctcaactcactctctacatttctcataacttccaaaatctattttcttcctcatacctgacgcatatactttctgctccctggctccttcagctgtactcactctttgttaagtcccacaattaccattgttcctggcccggacttcaatccagcctcccacattattccagacaccacacctgaccctcatgactgcatctctctgatccacctgatgttcatcccatttccccacatttccttcgtccctgtttctcaccctgatcacgcttgatttattgatggcagttccaccaggcctaatcaccacacaccagcaaaggcaggctatgctatagtacaagccactagcccgcctcttagaacctttcatttcctttccatcgtagaaatctatcctcaaggaaataacttcttagtgttccatctgctattccatctgctactcctcaaggattattcaggccccttccctacacaacaagctcgaggatttgcccccacccaggactggcaaattagctttactcaacataccccgagtcccaaaaactaaaatacctctttgtctaagtagacactttcactagataggtagaggcctttcctatagggtctgagaaggccactgcagtcatttcttcccttctgtcagacataattcctcagtttagccttcccacctctatacagtctgataaaagaccagcccttattagtcaaatcagtcaagcatttttttaggctcttagtatccagtg

SEQ ID NO: 690 - DNA, 366 bp, Homo sapiens
gtcaggcctctgagcccaagcctgcacgtatacatccagatggccagaagcaagtgaagaatcacaaaagaagtgaaaatggccagtgcctgccttaactgatgccattaccttgcgaaattccttctcctggctcagaagctcccccactgagcaccttgtaacccccgcccctgcccgccaaagaataaccgcctttgactgtaattttccactacctacccaaatcctataaaacagccccacccttacctccctttgctgactctctttttggactcagcccacctgcacccaggtgattaaaaaactttattgctcacacaaagcctgtttggtggtctcttcacatggacacgggtgaaa

SEQ ID NO: 691 - DNA, 5473 bp, Homo sapiens
gactctctttttggacttagcccgcctgcacccaggtgaaataaacagccatgttgctcacacaaagcctgtttggtggtctcttcacaccgacgcatatgaaatttggtgctgtgactcagatcgggggacctcccttgggagatcaatcccctgtcctcctgttctttgctccgtgagaaagatccacctacgacctcaggtcctcagacccaccagcccaaggaacatctcaccaattttaaatcaggtaagcggcctcttcttactttcttctccaacctctctcactgtccctcaaccactttctcctttccactcttcaatctctcccttctcttaatttcaattcctttcattttctgggagagacaaaggagacacgttttatccgtggacccaaaactccggcgccagtcacagactgggaaggcagccttcccttggtgtttaatcattgcagggacacctctctgattatacacccacgtttcaagggtgtcagaccacgcagggacgcctgccttgttccttcacccttagcggcaagtcccgcttttctggggaaggggcaagtacctcaaccccttctctccttgtctctaccccttttctgctttcctggggcaggggcaagtacccctcaaccccttctccttcacccttagcggcaagtcccgctttcctggggaaggggcaagtacccctcaaccccttctctttcacccttagtggcaagtcctgcttttctagggggcaagaatccccaatcgcttatttctgcaccccaacctcgtatctctgtgccccgaccccttatttctgtgccccaaccccttatttctgagtcccatcccttatttccgtgccccgacctcttatctctgcgccccaaccccttttcccacttttctggaaggtaagaacccccgaaccccttccctccatttctctactctctcttttctctaggcttgcttccttcactataggcaaccttccaccctccattcctccttctactcccttggcctgtgttctcaaaaacttaaaacctcttcaactcacacctgacctaaaacctaaatgcattttcttctgcaatgccgcttgaccccaatacaaactcgacagtagttccaaatagccagaaaatggcactttaaatttttccatcctgcaaaatctaaataattcttgtcgtaaaataggcaaacggtctgaggtgcctgacgtccaggcattcttttacacatcagtcccttcctggtctctgtgcccagtgcaactcatcccaaatcttccctctttccctcccgcctgtcccctcagtaccaaccccaagcatcactgagtctttctaatcttccttttttacagacccatctgacctctcccctcctccccaggctgctcctcgccaggccgagctaggtcccaattcttcctcagcctctgctcctccaccctataatctttttatcacctcccctcctcacacctggtccggcttacagtttcgttccgagactagccctcccccacctgcccagcaatttactcttaaaaagatggctggagccaaaggcatagtcaaggttaatgctcctttttctttatcccaaatcagatagcgtttaggctttttcatcaaatataaaaacccagcccagttcattgctcgtttggcagcaaccctgagacgctttacggccctagaccctaaaaggtcaaaaggccgtcttattcccaatatacattttattacccagtctgctcctgacattaaataaaactccaaaaattggaatctggccctcaaaccccacaacaggacttaattaacctcaccttcaaggtgtacaataacagaaaaaagttgcaattccttgcctccactgtgagacaaaccccagccacatctccagcacacaagaacttccaaacgcctgaaccacagaagccaggcgttcctccagaacctcctcccccaggagcttgctacacgtgccggaaatctggccactgggccaaggaatgcccgcagcccgggattcctcctaagctgcgtcccatctgtgtgggaccccactgaaaatcagactgttcaactcacctggcagccactcccagagcccctggaactctggcccaaggctctctgactgacttcttcccagatcttctcagcttagcggctgaagactgacactgcccgatcgcctcggaagccccctagaccatcacggatgccgagcttcgggtaactctcacagtggaaggtaagcccgtccccttcttaatcaatacggaggctacccactccacattaccttcttttcaagggcctgtttcccttgcctccataactgttgtgggtattgacggccaggcttttaaacctcttaaaactccccaactctagtgccaacttagacaatactcctttaagcactcctttttagttatccccacctgcccagttcccttattaggccgagacactttaactaaattatctgcttccctgactattcctggactatagccacatctcattgccacccttctccccaacccaaagcctccttcgcatcttcctctcatatccccccaccttaacccacaagtatgggacatctctactccttccctggcaaccgatcacatgcccattaccatcccattaaaacctaatcacccttaccccactcaacgccaatatcccatcccgcagcacgctttaaaaggattaaagcctgttatcactcgcctgctacagcatgggcttctaaaacatataaactctccttaccattcccccattttacctgtcctaaaaccagacaaggcttacaagttagttcagaatctgcgccttatcaaccaaattgttttgcctatccaccctgtggtgccaaacccatatactctcctatcctcgatacctctctctactacccattattctgttctggatctcaaacatgctttctttactattcctttgcacccttcatcccagcctctctttgccttcacttagactgaccctgacacccattaggctcagcaaattacctgggctgtactgccgcaaggcttcacagacagcccccattacttcagtcaagcccaaatttcatcttcatctgttacctatctcggcataattctcataaaaacacatgtgctctccctgctgatcgtgtccgattaatctcccaaacctcaatcccttacaaaagaacaactcctttccttcctaggcatggttagtgcggtcagaattcttacacaagagccaggaccacaccgtgtagcctttctgtccaaacaacttgaccttactgttttagcctagccctcatgtctgcgtgcagcagctgccactgctttaatactgttagaggccctaaaaatcacaaactatgctcaactcactctctacatttctcataacttccaaaatctattttcttcctcatacctgatgcatatactttctgctccctggctctttcagctgtactcactctttaagtcccacaattaccattgtttctggcccggacttcaatctggcctcccacattattcctgataccacacctgacccccatgactgtatctctctgatccacctgatattcaccccatttccccatatttccttctttcctgttcctcaccctgatcacgcttgatttattgatggcagttccaccagacccaatcgccacactccagcaaaggcaggctgtgctatagtacaagccactagcccgcctctcagaacctctcatttcctttccatcgtggaaatctatcctcaaggaaataacttctcagtgttccacctgctattctactactcctcagggattattcacgccccctcccttccctacacatcaagctcgaggatttgcccccacccaggactggcaaattagctttactcaacatgtcccgagtcaggaaactaaactattagacctcttagtctaaatagacactttcactgaataagtaaaggcctttcctacagggtctgagaaggccaccacagtcatttcttcccttctgtcagacataattcctcagtttagccttcccacctctatacagtctgataacagaccagcctttattagtcaaatcagccaagcagtttttcaggctcttagtattcagtgaaacctttatatcccttacggtcctccgtcttcaagaaaagtagaacggactaaaggtcttttaaaaacacacctcaccaagctcagccaccaacttaaaaaggactggacaatacttttaccactttctcttctcagaattcaggcctgtcctcagaatgctacaaggtgtacaggagcccatttaagctcctgtatagatgctcctttttattaggccccagtctcattcgacaccagaccaacttagactgtgcccccaaaaaaacttgtcatccctactatcttttgtctagtcatactcctattcaccattctcaactactcgtacatgccctgctcttgtttacactgccagtttacactgtttctccaagccatcacagctgatatctcctggtgctatccccaaactgtcactctaaactcttgaagtaaataaataatctttgctggcagggctatgctgagtctccttaggcactctctaatcagatgtcctgggtcctcccaattcttagaccttttatacctgtttttctccttctcttattccatttagtttttcaattcatacaaaactgtatccaggccatcaccaataattctacacgacaaatgtttcttctaacaaccccacgacatcaccccttaccacaaaatcttccttcagcttaatctctcccactctaggttcccacgccgcccctaatcccgcttgaagcagccctgagaaacatcgcccattctctctccacaccacccccaaaaaattttcgccgccccaacacttcaacactattttgttttatttttcttattaatataagaaggcaggaaagtcaggcctctgagcccaagccaagccatctcatcccctgtgacttgcatgtatatgcccagatggcctgaagtaactgaagaatcacaaaagtagtggaaaggccctgccccgccttaactgatgacattccaccattgtgatttgttcctgccccaccttaactgagtgattaaccctgtgaatttcctactcctggctcagaagctcccccactgagcaccttgtgacccccgcccctgcccaccagagaacaaccccctttgactgtaattttccattaccttcccaaatcctataaaacggccccacccctctctcccttcactgactctcttttcggactcagcccgcctgcacccaggtgaaataaacagccatgttgctcacacaaagcctgtttggtggtctcttcacaccgacgcgcatgaaa

SEQ ID NO: 692 - DNA, 2280 bp, Homo sapiens
tggccagttcctgccttaactgatgacattaccttgtgaaattccttttcctgactcatcctggctcaaaacctccccgactgagtaccttgtgacccccaaccctgcccgcctgagaacatccccctttaactgtaattttcctttacttacccaaaccctataaaacagctccatccctatctcccttcgctgactctcttttcggactcagcccgcctgcacccaggtgattaaaaagctttattgctcacacaaagcctgtttggtggtctcttcacacggacgcaagtgaaatttggtgcctccctgccaattgtgtctgaccccttctctctgtatctctaccccttctctacttttctggagggcaagaatcccctgaccccttctcttcgtgtctctaccccttctgcacttttctggagggcaagaaccccccaaccccttctctccgtgtctctactctcttttctctgggcttgcctccttcactatgggcaagcttctgccctccattcccccttcttctcccttagcctgtgttcttaaaaacctaaaacctcttcaattcacacctgacctaaaacctaaatgccttattttcttccgcaatgccgcttgaccccaatacaaatttgacagtggttccaaatagccagaaaatggcactttcaatttctacatcctacaatatctaaataattcttatcgtaaaataggcaaacagtctgaggtgcctgatgtccaggcattctttgacacctcggtccctccctagtctctgtccccaatgcgatttgtcccaaatcctccttctttccctctcgcctgtcccctcagtcccaaccccaagtgttgctgagtctttctaatcttccttttctacagacccatctgacctctcccctcatcaccaggtcaagctaggtcccaactcttcctcagcctccgctcctccaccctataatccttttatcacctcccctcctcacacccggtccggcttacagttttcttcctgcacctgcccagcaatgtcctcttaaaaagtggctgcagccaaaggcatagtcaaggttgatgctcctttttctttatccaacctctcccaaatcagttagcgtttagactctttcatcaaatatgaaaaacccagcccagttcacggcccctttggcagcaaccctgagacgctttacagccctagaccctgaaaggtcaaaaggccgtcttattctcaatatacattttattttattacccaatctgcacccaacattaaataaagctagaaaaattaaattccagccctcaaaccccacaacaggacttaactaacctcaccttcaaggtgtacaataacagaatagaggcagccaagtagcaacatatttctgagttgcaattccttacctccactgtgagagaaacctcaaccacatctccagcacacaaggacttcttccaaacacctaaaccacagtggccaggcgttcctccaggcctgcctcccccaagagcttgctacaagtgccagaaatctgaccaccgggccaaggaatgccggcagcccaggattcctcctaagccgtgtcccatctgtgcgggaccccactggaaattggactatcaaactcacccggcagccactcccagagcccctggaactctggcccaaggctctctggctctttcccagatcttcttcgcttagtggctgaagactgacgctgcctgatcgcctcagaatcttcttagaccatcacagatgctttaagtaactctcacagtagaaggtaagtccgtccccttcttaatcaatactgaggctacccactccacattaccttcttttcaagggcttgtttcctttgcctccataactgttgtcggtattgacggccaggcttctaaacctcttaaaactccccaactgtggtgccaacttgcacagcattcttttatgcactcctttttagttatccccacctgcccagttcccttattaggtcaagacattttaactaattatctgcttccctgactattcctaggctacagccacacctcgttgccgccttttcccccagttcaaagccgccttcacatcctgcccttgcatctccccaccttaacccagaagtataagatacctctactccctccttggcgactgatcatgtaccccttaccatcccattaaaacctaatcactcataccccactcaatgtcaatatcccatcccgcagcatgccttaaaaagattaaagcctgtt

SEQ ID NO: 693 - DNA, 6201 bp, Homo sapiens
gtcaggcctctgagcccaagctaagccatcatttcctgtgacctgcatgtacacatccagatggccggttcctgccttaactcatgacattccactacaaaagaagtgaaaatggcctgttcctgccttaactgatgacattatcttgtgaaattccttctcctggctcatcctggctcaaaagctcccctactgagcaccctgtgacccccactcctgcccgccagagaacaacccccctttgactgtaattttcctttacctacccaaatcttataaaacggcctcacccctatctccctttgctgactctctttttggactcagcctgcctgcacccaggtgaaataaacagccttgttgctcacacaaagcctgtttggtggtctcttcacatggacgcaagtgaaatttggtgctgtgactcgaatcaggggatcttccttaggagatcaatcccctgtcctcctgctctttggtctgtgagaaagatccacctacgacctctggtcctcagaccaaccagcccaaggaacatctcaccaattttaaatccagtaagcggcctctttttactctcttctccaacctctctcactatccctcaacctctttctcctttcaatcttggtgccacacttcaatctctcccttctcttaatttcagttcctttccttttctggtagagacgaaggagacacgttttatctgtggacccaaaactccggcaccggtcacggactggggaagacagtcttcccttggtgtttaatcacatggggacgcctgcctgattattcacccacatttcagaggcatctgaccacacggggacgcctgccttggtccttcacccttagtggcaagtaccgcttttctggagggcaagaaccccctaaccccttctctccatgtctctaccccttctctgcttttctggggggcaagaaccccccaactccttctccttcaccctcagcggcaagtaccgcttttctagggggcaagaaccccccgaccccttctctccatgtctctacttgctcttttctctgggcttgcctccttcactatgggcaagcttccaccctccattcccccttcttctcccttagcctgtgttcttaaaaacctaaaacctcttcaactcacacctgacctaaaacctaaatgccttattttcttctgcaatgccgcttgaccccagtacaaacttgacagtggttccaaatagccagaaaatggcactttcaatttttccatcctacaagatctaaataattcttgtcataaaataggcaaatggtctgaggtgcctgacatccaggcactcttttacacatcggtccctccctagtctctgttcccaatgcaacttgtcccaaatcttccttctttccctcccacctgtccccttagtcccaaccccaagtgtcgctgagtctttctaatcttccttttctacagacccatctgacctctcccctccttgccaggtcgagctaggttccaattcttcctcagcctccactcctccaccctacaatccttttatcatctcccctcctcacacccagtccggcttacagtttcgttcagtgacaagctctccccaacctgcccagcaatttcctcttaaaaaggtggctggagctaaaggcatagtcaaggttaatgctccttttccttatcccaaatcagatagcatttaggctctttttcatcaaatataaaaacccagtccagttcatggcttgtttggcagcaaccctgagacgctttatagccctagaccctaaaaggtcaaaaggccgtcttattctcaatatacattttattacccaatctgctcccgacattaaataaactccaaaaattaaattccggtgctcagaccccacaacaggacttaattaaccttgccttcaaggtgtacaataatagagtagaggcagccaagtagcaatgtatttctgagttgcaattccttgcctccactgtgagacaaaccccagccatatctccagcacacaagaactccaaacgcctgaactgcagctgccagggattcctccagaaccttctcccccgggagcttgctacaagtgctggaaatctggccactgggccaaggaatgcccgcagcccaggattcctcctaagccatgtcccatctgtgcgggaccccactgaaaatcggactgttcaactcacctggcagccactcccagagcccctggaactctggcctaaggctctctgactccttcccagatcttcttggcttagtggctgaagacggacgctgcccgatcacctcggaagccccctagactatcacggatgccgatcttctggtaattctcacagtggagagcaagtctgtccccttcttaatcaatatggaggctacccactccacattaccttcttttcaagggcctgtttcccttgcctccgtaactgttgtgggtattgatggccaggcttctaaacctcttaaaactccccaactctggtgccaacttagacaatactcttttaagcactcctttttagttatccccaacctgcccagttcccttattaggccgagacactttaactaaattatctgcttccctgactattcctgggctacagccacacctcattgccaccttttcccccagttcaacgcctccttcacatcccccccacttgtatctccccaccttaacccacaagtataggacaccactactccctccttagcgaccgatcatgcaccccttaccatcccattaaaacctaatcacccttaccccctcaatgccaatatcccatcccacagcatgctttaaaaggattaaagtctgttatcacttgcctgttacagcatggccttttaaagcctataaactccccttacaattcccccattttacctgtcctaaaaccagacaaggcttacaggttagttcaggatctgcgccttatcaaccaaattgttttgcctatccaccctgtggtgccaaacccatatactctcctatcctcaatacttccctccacaacccattattctgttctggatctcaaacatgctttctttactattcctttgcacccttcatcccagcctctctttgctttcacttggactgaccctcacacccatcaggctcagcaaattacctgggctgtactgccgcaaggcttcacagacagctcccattacttcagtcaagcccaaatttcttcctcatctgttacctgtctcagcataattatcataaaaacacacgtgctttccctgctgatcgtgtctggctaatctcccaaaccccaatcccttctacaaaacaacaattcctttccttcctaggcatggttagtgcggtcagaattcttacacaagagccgggacagcaccctgtagcctttctgtccaaacaactatgaccttactgttttagcctagccctcatgtctgcatgcagctgctgccactgctttaatacttttagaggcccaaaaaatcacaaactgtgttaaactcactgtctacagttctcataacttccaagatctattttctttctcccacctgatgcatatactttctgctccccggctccttcaggtgtactcactctttgttgaatctcccacaattaccattgttcctggcccagacttcaatccggcctcacacagtattccagataccacacctgacccctatgactgtatctctctgatccacttgacattcaccccatttccccgtatttccttctttcctgttcctcaccctgaacacacttggtttattgatggcagttccaccaggcctaatcgccacacaccagcaaaggcaggctatgctatagtacaagccactagcctgcctcttagaacctctcattttctttccatcgtggaaatctatcctcaaggaagtaacttcttccatctgctattctgctactcttcagggattattcaggccccctcccttccctacacatcaagctcgaggatttgcccccgcccaggactggcaactcttaactccctcttagagtggatagatgatctttgctggcaggggaccctccagtactttcaccctgacgaagttctattctttacttttatactcacttttattctcattcccattcctctgccaccctctacctctccccagctatctccaccacgctatcaaccttactcattctctcctagccgtttctaatccctccttagcaaacaaccactggctttgcatttccctttcttccagggcctacacagttgtccccaccttacatgcagactaggcaacacctcctgtctccctacacctccagacttcctttaacagccctcacttttaccctcctgaagaactcatttactttctagacaggtccagcaagacctccccagacatttcacatcagcaagctgccaccctcctccacacttacttgaaaaacctttctccttatatcaactctactccccccatatttagacctctcacaacacaaactactattcctgtggccgctcctttatgtatctctcagcaaagacctactggaattcccttaggtaatctttcaccttctcgatgttcctttactcttcatctccaaagccctcttcttgtttacttatacccagccccgaaaataacagtgaaaggttgctcgtagatactcaacgttttctcacacaccatgtaaatcgaacctccccctctacgcagttacttcatcaatccccattacaacctctgacggctgccaccctagctggatacctaggagtctgggtacaagacacccctttcagcactgcttctctttactttgcatctccagttttgcctcgcacaaggtctcttcgtctgtggatcctctacctacatgtgtctacctgctaattggacaggcacatgcacactagtcttccttacccccaaaattcaatttgcaaataggaccgaagagctccctgttcccctcatgacaccgacacgacaaaaaagagttattccactaattcccttgcttgtcggtttaggactttctgcctctactattgctctcggtactggaatagcaggcatttcaacctctgtcacgaccttccgtagcctctctaatgacttctctgctagcatcacagacatatcacaaactttatcagtcctccaggcccaagttgactctttagctgcagttgtcctccaaaaccgctgaggccttgacttactcactgctgaaaaaggaggactctgtatattcttaaatgaagagtgttgtttttacctaaatcaatctggcctggtgtatgacaacataaaaaactcaaggatagagcccaaaaacttgccaaccaagtaagtaattatgctgaacccccttggacactctctagttagatgtcctaggtcctcccaattcttagtcttttaatacctgtttttctccttctcttattccgtatagtttttcaatttatacaaaatcgtatccaggccatcaccaataattctacactacaaatgtttcttctaacaaccccacaatatcaccccttaccacaaaatcttccttcagcttaatctctcccactctaggttcccatgccgcccctaatcccgctcgaagcagccctaagaaacatcgcccattatctctccataccaccccccaaaatttttgccgtcccaacactttaccactatttcattttatttttcttactaatataagaagacaggaatgtcaggcctctgagcccaaggctaagccatcatatcccctgtgacctgcacgtatacatccagatggccggttcctgccttaactcatgacattccaccacaaaagaagtgaaaatggcctgttcatgccttaactgatgacattatcgtgtgaaattccttctcctggctcatcctggctcaaaagctcccctactgagcaccctgtgacccccactcctgccaccagcgaataacccccctttgactgtaattttcctttacttacccgaatcttataaaatggccccaccccatctccctttgctgactctctttttggactcagcccgcctgcacccaggtgaaataaacagccttgttgctcacacaaagcctgtttggtggtctcttcacacagacgtgagtgaaa

SEQ ID NO: 694 - DNA, 995 bp, Homo sapiens
aaggaaaggtgatgggaagaatgtggggaaaagaaagagagatcagattattactgtgtctgtgtagaaagaagtagacataagagactccattttgttctgtactaagaaaaattcttctgccttgagatgctgttaatctgtaactctacccccaaccctgttctccctgagacatgtgctgtgtccactcagggttaaatggattaagggctgtgcaggatgttcgttgttaaacaaatgcttgaaggcagcatgcttgttaagagtcatcaccactccctaatctcaagtacccagagacacaaaacactgcggaaggccacagggacctctgccgaggaaagccaggtattgtccaaggtttctccccatgtgatagtctgaaatatggcctcgtgggaagggaaacacctgactgtcccccagcctgacaccagtaaagggtctgtgctgaggagggttagtaaaagaggaaggaacgcctctttgcagttgagataagaggaaggcatctgtctcctgctcctccctgggcaatggaatgtctcggtgtaaagtccaattgtatattccatctactgagataggggaaaactgccttagggctggaggtgggacatgctggcagcaatactgctctttaaggcattgagatgtttatgtatatgcacatcaaaagcacagcacttttttctttaccttgtttatgatgcagagacatttgttcacgtgtttacctgctgatcttctctccactattatcctattgtcctgccacatccccctctctgggaaatgcccgataatgatcaataaatagtaagggaactcagaggccggtgtcagcgtgggtcctccgtatgctgaatgctggtctcctgggcccatttttctttctctatactttgcctctgcatctgtttattttccaagtctctctttccacctaatgagaaacgcccacaggtgtggaggggcaacccatcccttca

SEQ ID NO: 695 - DNA, 5827 bp, Homo sapiens
gtcaggcctctggtcccaagcctgcacatatacatccagatggcctgaagtaactgaagaatgacaaaagaagtgaaaatggtcggttcctgccttaactgatgacattaccttgtgaaataccttctcctggctcatcctggctcaaaagctcccccactgagcaccttgtgacccccacacctgccagccagagaataactcccttttactatacttttccactacctacccaaatcctataaaacggtctcacccctatctccctttgctgactctcttttcagactcagcccgcctgcacccaggtgattaaaaaggtttattgctcacacaaagcctgtttggtgatctcttcacacggatgcaggtgaaatttggtgtcatgactcggatcaggggacctcccttgggagatcaataccctgtcctcctgctctttgctccatgagaaaggtgcacctacaacatcgggtcctcagaccaaccagcccaaggaacatctcaccaattttaaatcatgtaagcggcctctttttactctcttctccaacctctctcactatccctcaacccctttctcctttcaatcttggtgccatccttcaatctctcccttctcttaatttcaattcttttccttttctggtagagacagaggagatgtgttttatccacgaccccaaaactccggtgctggtcatgaactcaggaaaacagtcttcccttggtgtttaatcactgcaaggatggctgcttgattattcacccacgtttcagaggtgtctgatcaccgcggggatgcctgccttgatccttcacccttagcggcaagcactgcttttctgggggcaagcagcccccaccctttctctccgtgtctctaccccttttccacttccctgggaggcaagcacctcccacccttctccactttccttgggggcaagcaccccccaccccttctctccatgtcctctcttttctctgggcttgcctccttcactatgggcaaacttccaccctccattcctccctcttctcccttagcctgtgttctcaaaaacttaaaacctcttcaactcacacctgacctaaaacctaaatgccttattttcttctgcaacaccgcttggccccaatacaaacttgataatggctctaaatggccagaaaactgcattttcagtttctccatcctacaagacctagataatttttgtcaaaaaatgggcaaatggtctgaggtgccttacatccagacatttttcacacttcgttccctccctagtctctgttcccaatgcaattcctcccaaatcatccttgtttccctcccgcctgtcccctcagtcccaacctcaagcatcgctgagtctttccaatcttccttttctacagacccatctgacctctctcctcctccccaggctgctcctcaccaggccaagccaggtcccagttcttcctcagcctctgctcctccaccctataatctttctatcacctcccctccttacacctggtctggcttacggtttagttctgtgactagctctccccaacctgcccaacaatttcctcttagagaggtggctggagctgaaggcatagtcagggtacatgtgcctttttctctatcggacctctctcagatcagtcagcgtttaggatctttctcatcaggccctactaaatatatacatgaattccaatatctaactctgtcctacaatttaacctggagtgacttaaatgtcatcctaacttttatcctcccactagatgaatgggaaagagttttttctctggcccaatctcacactgacaactgtcggctccacaagccagacctccaggaaggcattagagaagttccccaagaggatccccaatggaactatcaggaaaattccccaggtatagctaggcgagattacatgatttcctgcctagttgaagggcttaaaaaggcagcttacaaagctattaattatgacaagcttaaagaaactacccaaggtacagacaaaaacccagcccagtccatggcttgtttggcagcaaccatgagacactttgcagccctagaccctgaaggtcagaaggctgtctcattctaaatatgcattttatcacccagtcagctcctgacattagaaaagaacttcaaaaattagaatccggccctcaaaccccacaataggaattaatcaacctcgccttcaagatgtacagtaatagagaggagacaggcagatggcaacgcatttctgagttacaattacttgcctctgctgtgagacaaaacccagccgcacctccagcacacaagaacttcaaaatgcctaagctgcacatgcctaagccacagcagtcaagcattcctacaggacttcctccatcaggatcttgcttcaagtgccagaaatctggccactgggccaaggaatgcctgcagcctgggattcctcccaagctgtgtcccatctgtgcagggacccactggaaatcagactgcccagctcacccagcagccactcctagagctgctaaagctctaggccaaggctctctgactgactccttcccagatctgctcagcttagcggctgaagactgacgctgcccaatcacctcagaaaccccctggaccaacacggactccgagtttcgggtaattctcacagtggactgaccctgacacccatcagtcccagaagcttacctgggctgtgctgcctcaaggcttcagggacagccctcattacttcagccaagctctttctcatcatttactttctttccacccctccacttctcaccttattcaatatattgatgaccttctactttgtagcccctccattgaatcttcccaacaagacaccctcctgctccttcaacatttattctccaaagggtatcgggtatcccccaccaaagctcaaatttcttctccatccgttacctacctcagcataattcttcataaaaacacacatgctctccctactgatcacgtccaactgatctctcaaaccccaaccctttctacaaaacaactcctttccttcctaggcatggttggatactttcacctttggatacctggttttgccatcctaacaaaaccattatataaactcacaaaaggaaacctagctgaccccatagatcctaaatcttttccccactcctctttccgttccttgaagacagctttagagactgctcccacactagctctccctgactcatcccaatccttttcattacacacagccgcagtgcagggctgtgcagctggaattcttacacaaggaccgggactgtaccctgtagcctttttatccaaacaacttgaccttactgttttaggctggccatcatgtctccgtgcagcggctgccaccgccctaatacttttagaagaccccaaaatcacaaactatgctcaactcactctctacagctctcataacttccaaaatctattttcttcctcacacctgacacatatactttctgctccccagctccttcagctatactcactctttgttgagtctcccacaattaccattgttcctggcccagacttcaatccagcctcccacattattccagataccacacctgacccccatgactgtatctctctgatccacctgactttcaccccatttccccatatttccttctttcctgttcctcaccctgatcacatttggtttattgatggcagctccaccaggcctaatcagcactcaccagcaaaggcaggctatgctatagtatcttccatgtctatcattgaggctaccactctgcctccctccactacctctcagcaagctgaactcattgccttaacttgggtcctcactcttgcaaagggactacacatcaatatttatactgactctaaatacaccttccatatcctgcactaccatgctgttatatgggcagaaagaggtttcctcactatacaagtgtcctccatcattaatgcctctttaataaaaactcttctcaaggctgctttacttccaaagaaaggtggagtcattcactgcaagggccaccaaaaggcatcagatcccattgctctaggcaatgcttatgttaataaggtagctaaagaagtagctagcattccaacttctgtccctcatggccagtttttctccttctcatcggtcactcccacctactcccccactgaaacttccacctatcaatctcttcccacacaaggcaaatatcttagaccaaggaaaatatctccttccagcctcacaggcccattctattctgtcatgatttcataacctcttccatgttggttacaagctgctagcccgtctcttagaacctctcattttctttccatcatggaaatctgtcctcaaggaaatcacttctcagtgttccatccgctagtctactgtccctcaggtattgttcaggccccctcccttccgtacacatcaagcttggggatttgcccctgctcaggactggcaaattgactttactcacatgtcctgagtcaggaaactaaaatacctcttggtctgggtagacactttcactggatgggtagaggcctttcccacagggtctgagaaggccaccgtggtcatttcatcccttctgtcagacataattcctcagtttggccttcccacctctgtacagtctggtaacggaccggcctttactagtcaaattacccaagcagtttctcaggctcttggtattcagtggaaccttcataccccttaccatcctcaatcttcaggaaaagtaaaacagactaatggtcttttaaaaacacatctcaccaagctcagcctccaacttaaaaaggactggacaatacttttaccacttgcccttctcagaattcgggcctgtcttcaggatgctataggttacagcccatttgagcttctgtatggacactcctttttattaggccaccagcccacttgaactgcaccccaaaaacttggatagagcctaaaaactcaccaaccaagcaagcaattacgctaagccccctcggcactctctaattggatgtcctgggtcctcccaattcttagtcctttaatacctgtttttctccttctcttatttggaccttgtgtcttccgtttagtttctcaattcatacaaaactgcattgaggccatcaccaatcattctatatgacaaatgctccttttaacaaccccacaatatcgcctcttaccacaaaatcttccttcagcttaatctctcccactctaggttcccatgctgcccctaatcccgctcgaagcagccctgagaaacatcacccattatctctccataccactgccaaaacttttcactgccccaacactttaccactatttcattttatttttcttattaatataagaagacaggaatgtcaggcctctgggcccaagcctgcacgtatacatccagatggcctgaagtaactgaagaatgacaaaagaagtgaaaatagccagttcctgccttaactgatgacattaccttgtgaaacatcttctcctggctcatcctggctcgaaagctcacccactgagcaccttgtgaccctgacccctgctagccagagaacaaccccctttgactgtaattttccactacctacccaaatcctataaaatggccccacccctatctccctttgctgactctcttttcggactcagcctgcctgcacccaggtgattaaaaagctttattgctcacgcaaagcctgtttggtggtctcttcacatggatgcgcatgaaa

SEQ ID NO: 696 - DNA, 2670 bp, Homo sapiens
tgggccaggcacaaataagcccaacccactaggaactatgttgaaaaatttcaagaaagaatttaagggagattatggtgttactgtgacaccaggaaaacttagaactttgtgtgaaataggctggccagcattagaggtgggttggccatcagaaggaagcctggacaggtcccttgtttcaaaggtatgacacaaggtaacctgtaagccaaggcaccgagaccagtttccgtacatagacagttatagctggttttagacccccttccccgcaacagtagttaagagaacagcagcataagtggctggcagaggcaaggaaagaccagcagagagaaaaaaaggccatctataccaattctaagttaatttatactaaacaaggtcttattaatagcaaaggataattgaaatctcaaacttacaaggttttcaacaaaagtgaagtttgctaaaagttaacagtgtaacatgtattatggtaacttctaatcttgtggccttagacagtctagtccaaagacataaagaaagtttgctttaaaaaaaggaaaaaaaaaagggaagaggcagaatttatataaaaaaaaagttatatggtaaattcttgtcctgaaataaattaactggttgtttaaagaaaaaaatgtttgcaataagtcaaaaagttgagacatgttaaaaaaattgcgaaagtcatgaaaaaaagttataaaaaattttatgcaaaaaatgtcgtataatttaaaagtaataaggcctcctgagtaccattgaaaaaacagtttatgtgcaaggtgtataaaaaaagtaaaatatacctttagtaaaaagattataaagaggcataagaatgtggatttttacctacattaaaaggttaaaaaaattattgttttgaaagtttaagcaagttttaaaatgttaattgtaaagaaaattctgtgtgtaaatattagctaaagttaaaaaggtatcacccagtttttctgtgaactggacactaaagtaaaaatgcaacaggtttttcttaaagcatcaacctgctctttaacaaaaattataaaaggttaaaaagagtctataaaatcttacctaatggtcaaacatgaaaaattggataaatatgtctacaaggttttattaaaattaattttaacattaataacacactaatataaaggtaaaatttaacctatctggtataaaaatcatacaagaagcattattacatataaaatggtgtttagctttctttagtctaaaaactaataaaaattggtgctaaagaaaacattcattttactagaggatcataaaagttaaagacttaaactttagcaattaagacagcataccaagatgcaaatgcctggttgaaacggatcaaatattccatctgcacgttaaacaaaagcaattgttatgcttgtgcacatggcagcccagaggccctgattgtcccccttccactaaggtggtcctccagtcgaccaggcgtgggctgcatggtagctcttttccaggattctacagcctggagtaataagtcatgccaagctctctctgctatatcccaaagtccctgcgggtcagctcccgagggccatccagcttccgtctcccaacactaagttcacttcgtgtctctcacggctgggaggagacttagcattccttggagacctgaagggatgcagtgagcttaagaattttcaagagcttatcaatcagtcagtccttgttcatccctgagtggatgtgtggcagtattgtggtggacctttactaggcactctgctgaataactagagtggcacttgtgctttagtccatttggctatccctttcaccctggcatttcatcaaccagaggaaggaaaaaataataataataataataagacatcgtaaagcaagagaagccccttataggtctttcaactctcacatctatttagatgcaattggagccccgcaaggaataccagatcaatttaaaacttgaaatcaaatagttacaggatttaagtcaatattttggtagatgacagtcaataaaaatgtagattagataaactacatctattacacccaacagcaatgaacttttcatgagttaaaaaaaaaaaaactcatgtcggccccagccctgaggctacctgacctgacaaaactctttgcactctatgtgtcaaagagaaaaaatggcagttggagttttaacccagactgtagggccctggccaaggcctatctctcaaaacaactagatgaggtttccaaaggctggcccccatgtccaagggccctggtagcaatggccctgttagcacaaaaagcagataagctaactcttagacaaaacctaaacataaagtccccccatgctgtggtgattttaataaataccaaaggacaccattagctaatgaatgctagactaactagatagcaaagcttgctctgtgaaaatccccgcataaccattgaagtttgcaacaccctaaaccccgccaccttactcctggtatcagagagcccagttaaacataactgtgtagaagtattggactcagtttattctagcaggcccaaccaccgagaccacccctaaacatcagtagactgggagttgcacgtagataggagcagctttgccaaccc

SEQ ID NO: 697 - DNA, 359 bp, Homo sapiens
gtcaggcctctgagcccaagcctgcacgtatatatccagatggtctgaagcaacagaagaatcacaaaagaagtgaaaatggccagttcctgccttgactgatgacattaccttgtgaaattccatctcctggctcagaagcacccccactgagcaccttgtgacccccacccctgcccgcaagaacacaaccccctttgactgtaattttccactacctacccaaatcctataaaactgcccacccctaactccctttgctgactcctttttggactcagcccgcctgcacccaggtgaaataaatagctttattactcacacaaagcctgtttggtggtctcttcgcacggacgcgc

SEQ ID NO: 698 - DNA, 975 bp, Homo sapiens
gtggggaaaagaaagagagatcagattgttactgtgtctatgtagaaaaggaagatataagaaactccattttgatctgtactaagaaaaattgtttctgctttgagatgcgttaagctgtaactttagccccaaccctgtgctcacagaaacatgtgctgtattgaatcaaggtttaatggatttaggaatgtgtgggatgtgccttgttaacaatatgtttgcagtatgcctggtaaaagtcatcaccattctccattctcgattaaccagggacagaatgcactgcggaaagccacagggacctctgcccaagaaagcctgggtattgtccaaggtttccccccactgagacagcctgagatatggcctcatgggaagggaaagacctgactgtcccccagcccaatacccataaagggtctgtgctgaggaggagtagtgaaagagggaggcctctttgcagttgggataagaggaaggcttctgtctcctgctcatccctgggaatgcaatgtcttggtgtaaagctgaccattcccattcattctattgagataagagaaaaccacccggtggctggaagcgagatatgctggcagcaatactgctctgttactctttgctaaactaagatgtttgggtaaagagaaacataaatctagcctgtgtgcacatctgggcacagtacgtttccttgaacttattcatgatacagattcctttgctcacatgtttctgtgctgaccttctcccaacctgttgccctgctacactcccctcactaagatagtaaaaataatgatcaataaatactgagtgaactcagaggccggcgtcagtgcaggtcctccgtatgctgagcgctagtcccctgggcccactgttctttctctatactttgtctctgtgtcttatttcttttctcagtctctcgtccaacctgatgagaaatacccacaggtgtgggggggc

SEQ ID NO: 699 - DNA, 693 bp, Homo sapiens
ttacagagggtagctagtcagacatgagcagggcaggagagggacaccttcccaccaggaatgtcaggcaaccaacaggtgatgatcaggcagttatgaaactgtctctctaagataataattggtcacagccagtgccaaggaaaggccatctcccaataaacagaaacatctgaaactggtgatcagcagctcctgataagatctcaggagttgggtaagtgggctcatgcatgcacactaagaggaaaagtggtggagtttaactggtattatgaccttctaggacatttgactggtaagggaagaatgcctcaagtaaggatgcatacaatttcagtaaacacactgtgcatgctcccctcccaagtgctagcaggccactgcatgtgtgaacagcccacctcaagggaagaatcaggggagaagaaacacaagatcccagaagcatcccaacatataaaaccccaagaccaaaggtcaaaccatacacttgatctctcaagtcgcccacccgaccctcttccaagtgtactttacttcctttcattcctgctctaaagctttctaataaactttcactcctgctctaaaacttgcctcggtctcttcttctgccttatgaccttcagttgaattctttcttctgaggaggcaagaattgaggttgctgcagaccatacgaatacgcca

SEQ ID NO: 700 - DNA, 1016 bp, Homo sapiens
gtaggtagtcaggcagacatgagcagggcaggagagggccctcccccaacgaggaatgtcaagtggccatcagatgatggtcaggcagttgataaactgcttctctcaaataataattggtcgcagccagtgccagggagaggcagtctcccaacagatggaaacacctgaagctggtgatcagcttcccgataagatctcaggagctgggcgagtgggctcaagcatgcacactaagaggcaaaatggcagcgattaactggtagatgaccttcctctaggaacaccggtaagggaaaaacacctcaaatgagcgcgcacataacttcagtaaacacagctgtgcattcggcccctcccaggtgctgacaggccaccgcgcacgcagacagcccgccccaagggaagaatcaggggcgaagagagatgcaaccccccgggagcatgccaacctacaaaaccccgagtcaaaggtcaagccacacacttgcctctctcaagtcacctgcttggccctcttctaagtatactttacttcctttcatgcctactccaaaactttttttttttttttttttttttttttttctgagacggagtctcgctctgtcacccaggctggagtgcagtggcgcaatctcggctcactgcaagctccgcctcccgggttcacgccattctcctgcctcagcctccccagtagctgggactacaggcgcccgccaccacgcccagctaattttttgtatttttagtagagatggggtttctccgtgttagccaggatggtctcgatctcctgacctcgtgatccgcccgcctcggcctcccaaagtgctgggattacaggcgtgagccactgcgcccggcctctaaaacttttaaatacattttcactcctgctctaaaacttgcctctcactctgccttacgcccctcagtcgaattctttcttctgaggaggcaagaactgaggctgctgcagacccatatggatttgctgttgctaacagtac

SEQ ID NO: 701 - DNA, 930 bp, Homo sapiens
ggggaaaagaaagagagatcagattgttaatgtgtctgtatagaaagtagacataagagactccattttaatctgtaaccctacccccaaccctgtgttccctgagacatgtgctgtgtcaactcagggttaaatggattaagggctgtgcaagatgtgctttgttaaacagatgcttgaaggcagcatgctcattaagagtcatcaccactctctaatctcaagtacccagggacacaaacactgcggaaggctgcagggacctctgcctaggaaagccaggtattgtccaaggtttctccccatgtgacagtctgaaatatggcctcttgggaagggaaagacctgacagtcccccagcccgacacccataaagggtctgtgctgaggaggattagtaaaagaggaaagaacgcctctttgcggttgagacaagaggaaggcatctgtctcctgcctgtccctgggcaatggaatgtctcggtgtaaaacccgattgtatattccatctactgagataggggaaaaccgccttagggctggaggtggcacattcgggcagcaatactgctctttaaggcattgagatgtttatgtgtatacatatctaaagcacagcacttaattctttaccttgtttatgatgcagagacctttgttcacgtgtttacctgctgaccttctctccactattatcctatgatcctgccacatccgcctctccgagaaacacccaataatgatcaataaatactaagggaactcagaggccaataaatacaaagggatcctccgtatgctgaacgccggtcccctgggcccccttttttctttctatatactttgtgtctgtgtctctttcttttccaagtctctcgttccacctaacgagaaacacccacaggtgtggaggggcaacccaccccttca

SEQ ID NO: 702 - DNA, 5563 bp, Homo sapiens
gtcaggcctctgagcccaagctaagccatcatatcccctgtgacctgcacatatacgtccaggtggcctgaagcaagtgaagaatcacaatagaagtgaaaatggctggttcctgccttaactgatgacattccatcattgtgatttgttcctgccccaccttaactgagtgattaaccttgtgaaattccttctcctggctcagaacctccccaactgggcaccttgtgacccccacccctgcccgtaagagaaaaacccccttcgactgtaattttccactacccacccaaatcctataaaacagccccacccctatctcccttcactgactctctttttggactcagcctgcctgcacccaggtgactaaaaagctttattgctcacacaaagcctgtttggtggtctcttcacatgtgacgcacgtcacatggacgcacagtcacgcacatgggtgccgtgactcggatcgggggacctcccttgggagatcaatcccctgtcttcctgctctttttccataagaaagatccacctatgacctctggtcctcagaccaaccagcccaaagaacatctcaccaattttaaattgggtaagtggcctctctttactctcttctccaacctctctcactatccctcaacctctttctcctttcaatcttggtgccacatttcaatctctcccttctcttaatttcagttcctttccttttctggtagagacagaggagatgcattttatccatgaacccaaaactctggtgccagtcagacttgggaagacagtcttcccttggtgtttaatcaccatggggacacctgcttgattattcacccacgtttcagaggtgtctgatcaccacagggactcctgccttgatccttcacctttagtggcaagcaccactttcctggggggcaagcaccccccaacccttctctccatgtctctaccctctcttttctctgggcttgcctccttcactataggcaaccttccatgctccattcctccttcttctctcttagcctgtgttctcaagaacttaaaacctcttcaactcacacctgacctaaaacccaaatgccttattttcttctgcaatgctgcttgaccccaatacaaactcgacaatggttccaaatagccagaaaacggcactttcgattttccatcctacaagatctagataattcttgtcataaaatgggcaaacggtctgaggtgcctgatgtctaggcattcttttacacatcggtccctccctagtcccaatgcgactcatcccaaatcctccttctttccctcccgcctgttccctcagtcccaaccccaagcgttgctgagtcttttcaatcttccttttctaccaacccatctgacctgtcccctcatccccagactgcttcttaggtcactccctgccaggctgaatcagactccaattcttcctcagcttctgctcctccaccctataatccttctatcacctcctctccccacacccagtctggcttacagtttcattctgcaactagccctcccccacctgcccaacaatttcctcttaaagaggtggctggagctaaaggcatagtcaaggttaatgctcctttttctttatccaacctctcccaaatcagttaccgtttaggctctttttcatcaaatataaaaacccagcccagttcatggcccatttggcaacaacccttagacactttatggctccagaccctgaagggtcagaaggccatcttattctcaatatacattttattacccaatctgctcccaacattaaataaagctccaaaaattaaattccggccctcaaaccccacaacaggacttaattaaccttgccttcgaggtgtacaaaaatagagaagagttgcagttacttgcctctgctgtgagagaaaccccagccacatctccagcacacaagaacttcaaaatgcctaagctagagcagtcaggtgttccttcaggatcttctccatcaagatcttgcttcaagtgccagaaatctggccactgggccaaggaatgcccgcagcctgggattcctcctaggctgtgtcccatctgtgcaggactccactgaaaatcagaccgtccaactcacccggcagccactcccagagcccctggaactctggcccaaggctgtctgactgactccttcccagatcttcccagcttagcagctgaaaactgatgctgcccgattgcctcggaagcttcctggaccatcacagatgcttttggtaactcttacagtagagggtaaatctgtccccttcttaatcaatacggaggctaccaactccacattaccttcttttcaaaggcctgtttcctttgcctccataactgttgtgggtattgacagccaggcttctaaacctcttaaaactccccaactctggtaccaacttagacaatatgcttttatgcactcctttttagttatccccacctgcccagttcccttattaggtctaggcattttaactaaattatctgcttccctgactattcctaggctacagccacacctcactgccacccttttccccagttcaaagcctccttcatatcctctccttgtatctccccaccttaatccacaagtataggacacctctactccctcctttgcgaccgatcatgcaccccttaccatcctattaaaacctaatcacccttaccccgctcaatgccaatatcccatcccacagcatgctttaaaaggattaaagcctgttatagcatggccttttaaagcctataaactctccttacaattcccccattttacctgttcaaaaactggacaggtcttacaggttagttcaggatctgtgccttatcaaccaaattgttttgcatatccaccccgtggtgccaaacccatatactctcctatcctcaatacctccctccacaacccctccacaacccattattctgttctggatctcaaacatgctttctttactattcctttgcaccctttatcccagcctctctttgctttcacttggactgaccctgacatccatcaggctcagcaaattacctgggctgtactgctgcaaggcttcacggacagcccgcattacttcagtcaagcccaaatttcttcctcatccattacctatcttggcataattcttcataaaaacacacgtgctctccctgccgattgtgtccgactgatctctcaaacccccaaccccttctacaaaacaactcctttccttcctgggcatgattggatacttttgtctttggatacctggttttgtcatcctaaaaaaaccattctataaactcacaaaaggaaacctagctgaccccatagatcctaaatcctttccccactcctctttccattccttgaagacagctttagagactgctcgcacactagctctccctgactcatcccaacccttttttcattacacatagccaaagtgcagggctgtgcggtcaaaattcttacacaaggactgggaccacgccctgtggcctttttatccaaacaacttgaccttactgttttagcctagccctcatgtctgcgtgcagtggctgccactgccttaatacttttaggggccctcaaaatcacaaactgtgctcaactcactctctacagttctcataacttccaaaagctattttcttcctcacacctgatgcatatactttctgcccccctccactacttctcagcaagccaaactcattgacttgagccctcactcttgcaaaaggaccatgtgtcaatatttatactgactccaaatatgccttccatatcctgcaccaccatgctgttatatggtcaaaagagttttcctcattacgcaagggtcctccatcattaattcctctttagtaaaaactcttctcaaggctgttttacttccaaaggaagctggagtcattcactgcaagggccatcaaaaggcgtcagatcccatcgctcagggcaacacttatgctgataaggtagctaaagaagcagctagcattccaacttctgtcccttactaccagtttttctccttctcatcagtcattcccacctactcccccactgaaactgccacctatcaatctcttcccacataaggcaaatggttcttagaccaaagaaaacatctccttccagcctcacaggcccattctattctgtcatcatttcatagcttcttccatgtaggttacaagccactagcccatctcttagaccctctcatttcctttccattgtggaaatctgtcctcaaggaaatcacttctcagggttccatctgctattctactattcctcagggattgttcaggccccctcccttccctacccttgcccagaactggcaaattgactttattcatatgccccaagtcaagaaactaaaatacctcttggtctgtgtagacactttcattggatgaatagaggcctttcccacagggtctgagaaggccaccgccatcatttcttcccttctgtcagacataattcctcagtttggccttcccacctctatacagtccaataacagactggcctttactagtcaaatcacccaagcagtttctcaggctcttggtagtcagtggaaccttcatacccctttctgtcctcaatcttcaggaaaggtaaaatggactaatggtcttttcccaaaaactcgccaaccaagcaagtaattacactgaacccccttgggcactctttaattggatgtcctaggtcctcccaactcttagtcctttaatacctatttttctccttcttttatttggaccctgtagcttccgtttagtttctcaattcatccaaaaccgcatccaggccatcaccaatcattctatatgacaaacgctccttctaacaaccccacaatatcaccccttaccacaaaatcttccttcaacttaatctctcccactctaggttcccacgctgcccctaatcccgccctgagaaatatcgcccattatctctccataccacctccaaggatttttgctgccccaacacttcaatactattttatgttatttttcttattaatataagaaggcaggaatgtcaggcctctgagcccaagctaagccatcatatcccctgtgacctgcacgtatatgtccagatggcccgaagcaagtgaagaatcacaaaagaagtgaaaatggccagttcctgccttaactgatgatattcccccattgtgatttgttcctgccccaccttaactgagcaattaaacttgtgagattccttctcctggctcaaaacctcccccactgagcaccctgtgacccccacccctgcctgtaagagaaaaaccccctttgactgtaattttccactacccacccaaatcctataaaacagccccacccctatctcccttcactaactctcttttcggactcagcctgcctgcacccaggtgattaaaaagctttattgctcgcacaaagcctgtttggtggtctcttcacacggacgcacatgaaa

SEQ ID NO: 703 - DNA, 494 bp, Homo sapiens
ttcttagtcctttaatacctatttttctccttttattcggaccttgtgtctttcatttaggttagtttctcagttcatacaaaaccgcatccaggccatcaccaataaccctatatgacaaatatcaccccttaccacaaaatcttccttcagcttaatctctcccactctagactcccacgtcacccctaatcccgctggaagcagccctgagaaacatagcccattatctctccataccacccccaaaaattttcaccaccccaacactttaccactattttgttttatttttcttattaatataagaagataggaatgtcaggcctctgagcccaagctaagccatcatatcccttgtgacctgaatgtatacatccagatggcctgaagcaactgaagatccacaaaagaagtgaaaatagccttaactgatgacattccaccaatgtaatttgtttctgcccccaccaactgatcaatgtactttgtga

SEQ ID NO: 704 - DNA, 960 bp, Homo sapiens
gtggggaaaagaaagagagatcagactgttactgtctatgtagaaagaagtagacataagagactccattttgttctgtactaagaaaaattattgtgctttgtgatgctgctaatctgtaaccctacccccaaccctgtgctcgcagaaacatgtgctgtgtcgactcaaggtttaatggatttagggctatgcaggatgtgctttgttaaacaaatgcttgaaggcagcatgcttgttaaaagtcatcaccactccctaatctcaagtacccaggtacacaaaacgcaaagcagcagggacctctgcctaggaaagccaggtattgtccaaggtttctccccatgtgatagtctgaaatatggcctcgtgggaagggaaagacctgactgtcccccagcccgacacccgtaaagggtctgagctgaggagaattagtaaaagaggaaggcctctttgcagttgagataagaggaaggcatctgtctcctgcctgtccctgagcaatggaatgtctcggtgtaaaacccgattgtatgttccatctactgagataggagaaaactgccttaaggctggaggtgaaacatgctggcagcaatactgctctttaatgcaccagatatgtttatgtatgtgcacatcaaagcacagcacattttctaaccttgtttatgatacagagacatttgttcacatgttttcctactgaccctctccccactattaccctattgtcctgccacatccccttctccgagatggtagagataatgatcaataaatactgagggaactcagagaccggtgctggcccgagtcctccgtatgctgagcgcggtcccctgggcccacttttctttctctacactttgtctcttgtgtctctttcttttctcagtctctcatcccacccgatgagaaaagcccacaggtgtggagggtcaggccaccccttca

SEQ ID NO: 705 - DNA, 497 bp, Homo sapiens
atggaatgagaccaccacttctcctgttgtccttcccagcttctcccctacctcctcttttccctagtttataagacaggagaaaagggagaaagcaaaaagttggaaagaaacagaagtaagataaatagctagatgaccttggcgccaccatctggccctggtggttaaaataataataataatattaacccctgatcaaaattacttgtgttatctgtaaattccagacattgtatgagaaagcactgtaaaactttttgttctgttaggtgatgcatgtagcccccagtcacgttcctcatgcttgcttgatctattatgaccctttcacgtggatcccttagagttgtaagcccttaaaagggctaggaatttctttttcggagagctcagctcttaagatgagactctgccaactcttccagccgaataaaaacctcttccttctttaatctggtgtctgaggagttttgtctggggcttgtccggctaca

SEQ ID NO: 706 - DNA, 6574 bp, Homo sapiens
gtcaggcctctgagcccaagctaagccatcatatcccctgtgacctgcacgtatacatccagatggcctgaagcagctgaagatccacaaaagaagtgaaaatagccaggtgctgccttagctgatgacattccaccactgtgacctgttcctgccccaccctaactgatcaattgacctatgacaatacaccctccctgcccttgtgataatgtactttgtgatattcccctgcccttaagaaggtactttgtgatattcccccgcccttaagaaggtactgtgtgatattcccccgcccctaagaaggtactttgtgatattcccccgcccttaagaaggtactttgtgatattcccccgcccttaagaaggtactttgtgatattcccccgcccttaagaaggtactttgtgatattcccccgcccttaagaaggtactttgtgatattcccccgcccttaagaaggtactttgtgatattcccccgcccttaagaaggtactttgtgatattcccccgcccttaagaaggtactttgtgatattcccccgcccttaagaaggtacttgtgatattcccccgcccttaagaaggtactttgtgagatccaccccctgcccacaacaaattgctcctaactccaccgcctatcccaaacctgtaagaactaatgataatcccaccaccctttgctgactctcttttcggactcagcccgcctgcacccaggtgattaaaaagctttattgctcacacaaagcctgtttggtggtctcttcacatggatgtgcgcgacatttggtgccaaaacccgagaatggttctaaatggccagaaaatgacacttttgatttctccatcctacaagatctagataattttgtcgaaaaatgggcaaatggtctgaggtgactgacatcccggcattctttcacacatcggtccctccctagtctctgctcccagtgcgacttgtcccacatctttcttctttctcttctgtctgttccttcagtcccaaccccaagcgtcactaagtcttttgaatcttccttttctacccacccatctgacctctccccttcttcccacactgctcctcctcaggtcgctccctgccaggctgaatcaggctccagcttttcttgagcttccgctcccctaccctacaacccctctatcacctcccctgccacacccagtctggcttacagtttcattccatgacgagccctcccctacctgcccaacaatttcctcttaaagaggtggctggagctaaaggcatagtcaaggttaatgctcctttttctctatcagacctttcccaaatcagttagtgtttaggctcttttccatcaaatataaaaacccagcccagttcatggcccgtttggcaacaacccttagatgctttaccgccctagacccagaggggccagaaagccatcttattctcaatatgcgttttattacccaatctgctcctgatactagaaaaagctccaaaaattagattccagccctcaaaccccacaataggacttaattaacctcgccttcaaggtgtacaataataaaaaagagtcagccaagtggcaacatatttctgagttgcgattacttgcctctgccgtgagagaaaccctagccgtatccccagcacacaagaccttcaaattgcctaaaccgcagaggacaggcgttccttcaggacctcctcccccaggatgttgctccacgtgacggaaatctgaccactgggccaaggaatgccagcagcctgggattcctcctaagctgcgtcccatctctgcgggaccccactggaaattggactgtccaactatcccagcagccactcccagagcccctggaactctggcccaaggctctctgactccttcccagatcttcttggttcagcagctgaagactgatgctgcccgatcgcctcggaagcctcctggaccatcacagatgctttgggtaactcttacagtggagggtaagtctgtccctttcttaatcaatacggaggctacccactccacattaccttcttttcaagggccttttcccttgcctccgtaactgttgtgggtattgacagccaggcttctaaacctcttaaaactccccaactctggtgccaacttggacaatactcttttaagcactccttttcagatattcccacctgcccagcttccttattaggtcgagacattttagccaaattatttgcttccctgactattcctgggctacagccacacctcaataacctcccttcacaacccatcattctgttctggttctcaaatatgcttcctttactattcttttccatccttcatcccagcctctcttcgctttcacttggactgatcctgacacccatcaggctcagcaaattacctgggctgtactgccgcaaggcttcacagacagcccccgttacttcagtcaagccctttctcatgatttactttcattctgtccatctgcttctcaccttattcaatattttcacgaccttctactttatagctgcccccccccaccaaaatcttctcaacaggacaccctcctgttcctctaacatctattctcaaagggatatcacatattcccctccaaagcacaaatttcttcctcatcggttacctatctcggcatgattcttcataaaaacacacgtgttttccctgctgatcatgtccagctaatctcccaaaccccaaccccttctacaaagccacagctcctttccttcctaggcatggttaagtactttcacctttggatacctgattttgccatcctgactaaaccattacataaactcacaaaaggaaacctacctggccccatagatcctagatcctttccccactcctctttccattccttaaaaacagccctagaagctgctcccacactagctctccctaactcatcccaacccttttcattacacacaaccaaagtacaggactgtgcagtcggaattcttacacaagagctgggaccgtgccctatagcctttctatccaaacaactcaacttcacaattctgggctggccctcatgtttgtgccatttaaatacttctagaggccatcaaaaatcacaggctatgctccacttaccctttacagctctcacaaccttcaagcattaatatcctcctcatacctttcacatttattgtctgccccccaactcctccagctctattcactctttgttgaaactccaatagtaactattacccatgggcctgatttcaacccagcttctcatttagcacccaacacaagtcctgaaccacatgactgtatttccctaacacacataggatcttctccctttcctcatatttctaatcttcccattccaaacccggaccacacttggtttattgatggcggttcttctaaacccaatcaattttcaccagctaaagctggatatgctgtcatgtcccacacctctattattgaagctgctgcacttcctccctccaccacttcccaacaagccaaactgattgctttaactcgtgtgctctctctagctaaaggaatgcacattaacatttatactgactccatatatgctttccacatcctccataaccatgctgccatctgggtcaaaagaggcttccttaccacacaaagctcttccactaataatgcctccctaatagaggcccttaaggttgttctcctgccagccaaggctggaatcattcattgtaaaggacaccagaaacctactgatcttattgcaaaaaaaaaataaccaatgcctccacacccgctaatattccagcccccactccggagggccagtatttttttttctcctctatcactcccacctactcttcttctgaaaacctgctctaccagtcttttccaactcagggcaagtggttcttagatcatggaaaactcatccttcctgcctcacaagctcagtccattctttcgtcttttcataacctcttccatgtaagttacaagccactagcccgcctcttagaacctctcatttcctttaagacatttgccctgcatttcactccatccttagctaccttccccttgttctttggactctcctcttagcccctcctcttgcttgcttatacccagccccatgaatagcagtgaacggttactcgtagacactttgtactttctcatacaccataaaaatcaaacctccccttctacccagttgctccatcaatccccattacaacctctaacggctgctgcccttactaaatccctaagagtctgggtgcaagacacctgttttggtgctccctcttgtcttttcactttacatttccagttttgccttacaaagttctcttcttggacatgaacagacacttctcaaacgaagacatttatgcagccaaaaaacacatgaagaaatgctcaccatcactggccatcagagaaatgcaaatcaaaaccacaatgagataccatctcacaccagttagaatggcaatcattaaaaagtcgggaaacaacaggtgctggagaggttgtggagaaataggaacacttttacactgttggtgggactgtaaactagttcaaccattgtggaagtcagtgtggcgattcctcagggatctagaactaggaataccatttgacccagccatcccattactgggtatatacccaaaggactataaatcatgctgctataaagtcacgtgcacacgtatgtttattgcactattcacaatagcaaagacttggaaccaatccaaacgaccaacaatgatagactggattaagaaaacgtggcacatatacaccatggaatactatgcagccataaaaaatgagaagttcgtgtcctttatagggacatggatgaaattggaaatcatcattctcagtaaactatcgcaaggacaaaaatccaaacaccgcatgttctcactcataggtgagatttgaacaatgagaacccatggacacaggaaggggaacgtcacactctggtgactgttgtggggtggggggaagggggagggatagcattaggagatatacctaaagctaaatgacgagttaatgggtgcagcacagcagcatggcacacgtatacatatgtaactaacctgcacattgtgcacatgtaccctaaaacttaaagtataataataataataataataataataaaaaagatgtcttcctcctctgtggctccttcacctacatgtgtctacctattaattagacaggcacatgtacactagttagccttacccccaaaatcaatttgcaaataggaccgaacagcttcctgttcccctcatgacactaacactttacttctattttgtttttttattattattattaatataagaaaacaggaacaggccttgacttactcactgctgaaaaaggaagactctgtgtatttttaaatgaagagtgttgtttttacctaaatcagtctggcctggtatatgacaacataaaaaaatgcaaggatagagcccaaaaactcatcaaacaagcaaataattaggctgaacccccttgggcactctctagttgaatgtcctgggtcctcccaattcttagtcctttgatacctgtttttctctttctcttacttggcccttgtgtcttccaattaatctctcaattcctacaaaactgcatccagactatcactaatcactctatatgacaaatgctgcttctaacaaccccacaatatcaccccttaccccaaaatctttcttcagtttaatcactcccactctaggttcccacactgcccctaatcctgctcaaagcagccctgagaaacatcgcccattatctctccataccacccgcaaaaatttttgccaccccaacacttcaccaccattttgttttgtttttcttattaacagaagaagacaggaatgtcaggcctctgagctcaagctaagccatcatatcccctgtgacctgcatgtatacatccagatggcctgaagcaactgaagatccacaaaagaagtgcaaatagccaggtcctgccttagctgacgacattccaccattgtgacctgttcctgccgcaccctaactgatcaattgaccttatgacaatacaccctccccgcccttgcgataatgtactttgagatattcccctacccttgagaaggtactttgtgatatttccccacccttgagaaggtactttgtgatattctcccacccttgagaagttactttgtgatattcccccacccttgagaaggtactttgtgatattcccccacccttgaaaaggtactttgtaatactctccctgcccttgagaatgtactttgtgagatctaccccctgctcctaactccaccgcctatcccaaacctataagaactaacgataatcccaccacactttgctcactctcttttcagactcagcccacctgcacccaggtgattaaaaagctttattgctcacacaaagcctgtttggtggtctcttcacatggacgtgcgtga

SEQ ID NO: 707 - DNA, 406 bp, Homo sapiens
gtcaggcctctgagcccaagctaagccatcatatccccctgtgacctgtaggtatacatccagatggcctgaagtaactgaagaatcacacaagaagtgaaatttaaatggcctgttcctgccttaactgatgacattaccttgtgaaattccttctcctggctcatcctggctcaaaagctcccccactgagcaccttgtgtcccccgcccctaccggccagagaacaaccccctttgactgtaattttcctttacctacccaaatcctataaaacagtcccacccctatctcccttcgttgactctctttttggactcagcccgcctgcacccaggtgaaatgaacagccttgttgctcacacgaagtctgtttggtgatctcttcacacggacgcgagtgaaa

SEQ ID NO: 708 - DNA, 710 bp, Homo sapiens
ttacagtaggtagctagtcagacatgagcagagcagaagagggctcccccaaccaccccatacacacacacacccggaatgtcaggcaaccatcaggtgatggtcaggtggttgttaactgtctctctaaaataataattggtaacaaccagcaccagagaaaggcagtcttctaataatctgaaacacctgaaactggtgatcagcagcttcccaataagatcccaggagttggccaagtaggctcaagcacgtacattaagaggcaaaatggcagagtttaactggtatatgaccttctaggaatattcagctggtaagggaaggatgactcaagtgagaatgcatataactccagtaaacacattgtgcatgcatacctaacaagtgctagcagaccactgcatatgcagacagctcatcccaagagaagaatcaagggagaagagatgcagaccccgtaagtatgccaacatataaaaccccaagtcaaaaggtcaaatggtgcacttgtcctcaagttgccctcttggccctcttccaagtgtactttactttcttttcattcctgttctaaagctttttaataaaccttcactcctgctctaaaacttgcctcagtctattcttctgccttatgctcctcagtcaaattctttcttctgaggaggcaagaattgaggttgctgcagatccatacaaatgtgcca

SEQ ID NO: 709 - DNA, 1846 bp, Homo sapiens
atcttccagtcctccagcaggctagacaggaaattcgccaggctgctaatcttctcttgcctcctccaaactcccagccatgtgaagataccttagctgggcaatcagtccttgtcaagtctgacccctcacactctacagctttgatggactggaccctacctggtcatttatagcaccccaactgccatccgtctgcacgaccctccccattggattcactgttccagaataaagctgtgcccatcagacagccagcctgatctctcctcttccttctggaagtcgcaagtactcacccctacttcccttaaactcactcgcatttctgaagaacaataataacccttatgagcctaatacatctcttcattctattaagtctatttatccttaccctactttttgcaacagagctctacgcagtcacccccactatttggactgtgcccccaaaatttgtcatctccactatcttctgtctagtcatactcctattcaccattctcaatgactcataaatgccctgcccctgtttacactgccagtttacacttttcctccaaaccatcatagtggatatctcctggtactatccccaatccgccactcttgactccctcttggagtggacagatgatctttgctgacagggcaccctccaatactttcaccctgatgaagttctattctttacttttatactcactcttattctcgttcccattcttatgccaccctctacctctcctcagctatctccaccacactatcaatctcactcactctctcctagccatttctaatccttcttaacaaacaattgcttcctttgcatttctctttcctccaaaactgctgaggccttgacttactcactgctgagaaaggagaactctgtatatttttaaatgaagagtgttgtttttacctaaatcaatctggcctggcatatgacaacataaaaaaaactcaaggatggagaccaaaaactcaccaaccaagcaaataattatgctgaacccccttgggcactctctaattggatgtcctgggtcctcccagttcttagtcctttaatgcctgtttttctccttctcttattcagaccttgtgtcttccgtttagtttctcaattcatacaaaactgcatccaggccattaccaatcattctatatgagaattgctctttctaacaaccccacaatatcaccccttaccacaaaatctttcttcagtttaatctctcccactctctaggttcctgtgtcacccctaatcctgcttgaagcagccctgagaaacatcacccattatctctccataccacccccaaaaattttcgctgccccaacatttcatcactattttgttttgtttttcttattaatataagaagacaggaatgtcaggcctctgagcccgagctaagccatcatatcccctgtgacctgcgcttatacatccagatggcctgaagcaactgaagaaccacaaagaagtgaaaatacccagttcctgccttaactgatgacattccaccattgtaatttgttcctgccccaccctaactgatcagttgaccttgtgacattccttctcctggacaataaatctcaggagctccccactgagcaccttgtgacccccgcctgtacccgcaagaggacaaccccctttaactgtaattttccactacctacacaaatcctataaaaccgccccatccctatctccctttgctgactcttttttcagactcagtctgcctgcacccacatgattaaaaagcttaattgctcacacaaagcctgtttggtggtctcttaacatgaatgcacgtaa

SEQ ID NO: 710 - DNA, 107 bp, Homo sapiens
ttaggcctctgagcccaagctaagccatcatatcccctgtgacctgcacgtatacatccagatagcctgaagcaactgtaaaaatatccttaactgatgacattcca

SEQ ID NO: 711 - DNA, 1620 bp, Homo sapiens
gtcaggcctctgagcccaaaccaagccatcgcatcccctgtgacttgcacgtatacacccagatggcctgaagtaactgaagatccacaaaagaagtaaaaatagccttaactgatgacattccaccattgatttgttcctgtcccaccctaactgatcaatgtactttgtaatctcccccacccttaagaaagttctttgtaattctccccacccttgagaatgtactttgtgagatccacccctgcccgcaaaacattgctctcaacttcaccgcctatcccaaaacctataagaattaatgataatccatctcccttcgctgactctcttttcggcacccaggtgaaataaatacccatgttgctcacacaaagcctgtttggtggcctcttcacacggacgcacatgaaaccagctacttgggaggctgaggcaggagaattgcttgaacccgggaggcggaggttgcggtgacccgagatcacgccattgcactcctgcctgggcaacaagagcaaaattccgtctcagggaaaaaaaaaaaattagctgggtgtggtggggcaggcctgtaatcccagctactcaggaggctgaggcaggagaatcacttgaacctgggaggcggaggttgcagagtcgagatcatgccattgccctccagcctgggcgactgagtgagactccatcttaaaaaaaaaaaaaaaaaaagtcttttattactttttgagcatttaaagagtattttttggccagacggtgtggctcacgcctgtaatcccagtattttgggaggcccaggcgggtggatcacttgaagcctccagcctggccaacatggcaggagaatgactggaacccgggaggtggatgttgcagtgagccaagatggtgtcactgcactccagcctgggtgacagagagagactctgtctcaaagacaaaaagaaaatttgttcagtattttcttcaatcagctttctcagactgaatgttcacccttttaaatattcataatgttcctgagaatccatttggctattctgttttcttcacccttctccagccttcccctcctcaattcgacccatttcttccctacttcccaaaagaaaaaatatctactttggattaatataaatcagtttaatctaacttattcaagacttttttggcctctacttggaggttcaagaaaaggtgtgtcaggcctctgagcccaagctaagccatcatatcccctgtgacctgcacatacacatccagatggccggttcctgccttaactgatgacattccaccacaaaagaagtgaaaatggcctgttcctgccttaactgatgacattgtcttgtgaaattccttttcctggctcatcctgtctcaaaaagctcccctactgagcaccctgtgacccccactctgtccgccagagaacaacacccctttgactgtaattttcctttatctacccaaatcctataaaacagccgcacccttatcttccttcgctgactctctttttggactcagcccgcctgcacccaggtgaaataaacagccatgttgctcacacaaagcctgtttggtggtctcttcacacgcacgagcatgaaa

SEQ ID NO: 712 - DNA, 663 bp, Homo sapiens
ttacagtaggtaactagacagacatgagcagagcaggagagggctcccctcgtccccaccaccacacgcaccaggaatatcaggtgaccatcaggtgatggtcaggcggttgttaactgcctctctaaaataataattggttgcagttggtgccagggaaaggcaatgtcttaatagataggaaaaacctgaaactggcaaccagtagcttcccagtaagatctcaggagctgggtgagtgggctcacacatgtttgctaagaggcaaaatgacagagtttaactggtatatcacctcctagaaacatttgacttgtcaggaaagaatgcctctatggagcgtgtgtacaactccaataaacacaccaactgagcttgctcccctcccaagtgctagtaggccactgtgcatgcagacagcccaccccaacaaaagaccccggaagtgtgccaacgtataaaaccccaagtcaaaggtcaaatagagcacttgatctctcaagttgcccgcttggccctcttccaagcatactttacttcctttccttcctgatctaaagctttttaataaacttccattcctgctctgaaacttgcctcagactctctttttgccttatccccctctgtccgattctttcttctgaggaggcaagaactcag

SEQ ID NO: 713 - DNA, 5653 bp, Homo sapiens
gtcaggcctctgagcccaagctaagccatcatatctcctgtgacctgcatgtacacatccagatgactggttcctgccttaactgatgacattccaccacaaaataagtgaaaatgacctgttcctgccttaactgatgacaatatcttgtgaaattccttctcctggctcatcctggctcaaaagctcccctactgagcaccttgtgacccccactcctgcctgagaacaacccccctttgactgtaattttcctttacctacccaaatcttataaaatggccccgcccctatctccctttgctgactctcttttcagactcagcccgcctgcacccaggtgaaataaacagtcttgttgctcacacaaagcctgtttggtggtctcttcatatggacgcgcatgaaatttggtgccgtgactcggattgggggacctcccttgggagatcaatcccctgtcctcctgctctttgctccatgagaaagatccacctacgacctcgggtcctcagaccgaccagcccaaggaacatctcaccaatttcaaatccggtaagtggcctctttttactctcttcttcaacctccctcactatccctcaacctctttctcctttcaatcttggcgccacacttcaatctctcctttctcttaatttcaattcctttcattttctggtaaagacaaaggagacacattttatccgtggacccaaaactccggcgccggtcacggactcgagaaggcagccttcccttggtgtttaatcattgtggggacgcctctctgattattcacccacgttccattggtgtctgatctccgcggggatgcctgccttgatcattcacccacattcctttggtggcaagtcaattgtggggatgcctgctttggctgctcacccatgttgcagcccagggctgctccccacccccttctccgtgtctctacccttctctttaaacttgccttcttcactatgggcaaccttccaccctccattcctcctctcccttagcctgtgttctcaagaacttaaaacctcttcaactcacacctgacctaaaacctaaatgccttattttcttctacaatgtcacttgaccccaatacaaactcaacagtggttccaatagccagaaaacaacactttcgatttttccatcctacatcatctaaataattcttgttgtaaattgggcaaacggtctgaggtgcctgatgtccaggcattcttttacacatcggtccctctctagtctctgttcccaatgcagctcgtcccaaatcttcctcccctcccactggtcccctcagtcccaaccccaagcgtcgctgagtctttctaatcttccttttctacagacccatctgacctctcccctccttgccaggccgagctaagtcccaattcttcctcagcccctgctcctccaccctataatccttttatcacctctcctcctcacacctggtccagcttacggtttcattctgtgattagccctcccccacctgccccagcaatttcctcttaaaaaggtggctggagctaaaggcatagtcaaggttaatgctcctttttctttatctggtctctcccaaatcagttagtatttaggctctttttcatcaaatatgaaaaacccagcccagttcatggctcatttggcagcaaccctgagacgctttacagccctagaccctgaaaggtcaaaaggctgtcttattctcaatacacattttattttattacccaatctgctcccgacattaaataaagctccaaaaattaaattccagccctcaaaccccacaacaggacttaattaacctcgctttcaaggtgtacaataatagagtagaggcagctaagtagcaacatatttctgagttgcaattccttgcctccactgtgagacaaaccccagccacatctccagcacacaagaactccaaatgcctgaaccgcagctgccaggggttcctccagaacctcctcccccaggagcttgctacgagtgccagaaatctggccactgggccaaggaatgcccacagcccaggattccttctaagccatatcccatctgtgcgggaccccaatgaaaatccgacgttcaactcacctggctgccacttccagagcccctggaactctggcctaaggctctctgactgactccttcccagatcttctcggcttagcagatgaagactgacactacccaatcgccttggaagcctacaggaccatcacagacactctgggtaactatcacagtggagggtaagtccatccccttcttaatacggaggcaacccactccacattaccttcttttcaaaggcctgtttcccttgcctccataactgttgtaggtattgacggccaggcttctaaacctcttaaaactccctaattctggtgccaacttagacaatactcttttaagcactcctttttagttatccccacctgcccagttcccttattaggccgagacactttaactaaattatctgcttccctgactgtgcctggactacagccacacctcattgccaccttttcccccagttcaaaacctccttcacatcctccccttgtatctccccaccttaacccacaagtatgatacctctactccctccttggtgaccgatcatgcaccccttaccatcccattaaaacctaatcaaccttaccccgatgaatgccaatatcccatcccacagcacactttaaaaggattaaagcctgttatcactcacctgttacagcatggccttttaaagcctagaaactctccttacaattcccccattttacctgtcctagaaccaaacaagccttactggttagttcaggatctgcgccttatcaaccaaattgttttgcctatccaccccatggtgccaaacccatatactctcctatcctcaatacctccctccacaacccattattctgttctggatctcaaacatgctttctttactattcctttgcacccttcatcccagcctctcttcactttcacttgcactgaccttgacacccattaggctcagcaaattacctgcaagaattcacagacagcccccattatttcagtcaagcccaaatttcttcctcatctgttacctatctcggcataattctcataaaaacacacgtgctctccctgctgatcgtgtccagctgatctctcaaaccccaacaccttctacaaaacaacaattcctttccttcctaggcatggttagatactttcaactttagatacctggttttgccatcctaacaaaaccactatataaattcacaaaaggaaacctagctgaccccatagatcctaaatcctttccccactcctctttccgttccttgaagacagctttagagactgcccccacctagctctccctgactcatcccaaccattttcattacccacagccaaagtgcaggactgtgcagtcagaattcttacacaagaaccaagaccgtgccctgtagcctttttatccaaacaacttgaccttactgttttgcctagccctcaagttctgcatgcggtggctgccgccgccctaatacttttagaggcccttaaaatcacaaactatgctcaattcactctctacagttctcataacttccaaaatctattttcttcttcacacctgacacatatactttctgctccccagctccttcagctgtactcactctttgttgagtctcccacagttaccatttttcctggcccggacttcagtccggcctcccacattattcctgatgctacacctgacccccataactgtatctctctgatccaactgacattcaccccatttccccatatttccttctttcctgttcctcaccctgatcacacttggtttattgatggcagttccaccaggcctaatcgctacacaccaacaaaggcaggctatgctatagtaaaagccactagcccgcctcttagaacctctcatttcctttccatcgtggaaatctatcctcaaggaagtaacttctcagtgttccatctgctattctactacttctcagggattattcaggccccctcccttccctacacatcaagctcgaggatttgtccccacccaggactggcaaattggctttactcaacatgccccgagtcagatgactaaaatacctcttagtctaggtagatactttcactggataggtagaggcctttcctacagggtctgagaatgccaccgcagtcatttcttcccttctgtcagacataattcctcagtttagccttcccacctctatacagtctgataacagaccaacctttattagtcaaatcagcgaagcattttttcaggctcttagtattcagtgaaacctttatatcccttatggtcctcagttttcaggaaaagtagaatggactaaagatcttttaaacacacacttcatcaagctcagccaccaacttaaaaaggactggacaatacttttaccacttttccttctcagaattcaggcctgtcctcacaatgctgcagggtacagcccatttgagctcctgtatagatgctcctttttattaggccccagtctcatcccagacaccagaccaacttggcctgtgccccaaaaaacttgtcatccctactattttctgtctagtcatactcttattctccgttctcaactactcatacatgccctgctcttgtttacactgccggtttacactgtttctccaaggcatcacagctgatatctcctggtgctatccccaaactgccactcttaactcttaaagtaaataaataatctttgctggcaaggctatgctgaacctctttaggcactctctaattagatgtcctaagtcctcccaattcttagtcctttaatacctgtatttctccttctattattccgtttagtttttcaattcatacaaaaccgtatccaggccatcaccaataattctacacgaaaatgtttcttctaacaacctcacaatatcaccccttaccacaaaatcttccttcggcttaatctctcccactctaggttcccacgctgcccctaatcccgcttgaagcagccctgagaaacatcgcccattatctctccataccaccccccaaaattttcaccatctcaacattttactgctatctagttttatttttcgtattaatataagaagacaggaatgtcaggcctctgagcccaagctaagccatcatatcccctgtgacctgcacgtacacatccagatggccagttcctgccttaactgatgacattccaccacaaaagaagtgaaaatggcctgttcctgccttaactgatgacattatcttgtgaaattccttctcctggctcatcctggctcaaaagctcccctactgagcaccttgtgacccccacacctgcctgccagagaacaagtcccctttgactgtaatttccctttacctacccaaatcctataaaatggccccacccctatctcccttcgctgactctcttttcggactcagcccacctgcacccaggtgaaagaaacagccttgttgctcacacaaagtctgtttggtggtttcttcacacagatgcgcacgaaa

SEQ ID NO: 714 - DNA, 5270 bp, Homo sapiens
ctgagcccaagctaagccatcatatcccctgtgacctgcacgtatacatccaaatggcctgaagcaactgaagaatcacaaaagaagtgaaaatggctggtttctgccttaactgatgacattaccttgtgaaattccttctcctggctcagaagctcccccactgagcaccttgtgacccctgcctctgctcaccagagaacaaccctttgactgtaattttccattacctacccaaatcctataaaactgcccaacccctatctcccttcactgactccttttttggactcagctcacctacacccaggtgattaaaatctttattgctcatacaaagcctgtttgatggtctcttcacacggacgtgcatgacatttggtgttgaagacctgggacaggaggactcctttgggagaccagtcctctgtccttgtcctcactctgtgaggagatccacctacgatctcgggtcctcagaccaaacagcccaaggaacatcttaccaatttcaaatcagataagcagtcttttcactctcttctccagcctctcttgcacccttctatctccctctgtcgctacccttcaatccccctgtccttccaattccagttctttttcctctctagtagcgacaaaggagacacattttatccatggacccaaaactccagtgccagtcacggacttgggaagacggtcttcccttggtgtctaatcactacggggatgcctgcctgattattcacccacactgcattggtgtctgatcaccacagggatgcctgtcttggtcattcacccacattcccttggtggcaagtcaattgcggggatgcctgctttggctgctcaccatcccccttctccatgtctctaccctctcttttctctgggcttgcctccttcactatgggcaaccttccaccctccattaccccttctcctttagcctgtgttctcaaaaacttaaaacctctttgactcttacttgatctaaaatctaagcgtcttattttcttctgcaacaccgcttggccccagtacaaactcgataattgttctaaatagccagaaaatggcactttggatttctccattttacaagatctggatgatttttgttgaaaaatgggcaaatggttctgagatgcctgatgtccaggcatccttttacacattggtccctccctagcctctgctcccaatgtgacttgtcccaaatctttcttctttctctcctgtctgttccttcagtctccactccaagctctgagtcctttgaatcctccttttctacggacccatccgacctctccactcctccccaggctgctcctcaccaggccgagcctggccccaattcttcctcagccctcagcctccactcccccaccctatagtccttttatcaccttccctcctcacacccagtctggcttacagtttcattcgtcaactagccctcccccacctgcccaacaatttcctcttgaagaggtggctgaagctgaaggcatagccaaagttaatgctccttttcctttatctgacatctcccaaatcagttagaatttaggctctttttcatcaaacataaaaactcaacccagttcatggcccatttggcaacaccccttagacgctttaccgccctagactcagaggggccagaaggctctcttattctcaatattcattttattacccaaccagctcccgacattagaaaaagctctaaaaattagattctgaccttcaaaccctgcaacaggacttaactaacctcgccatcaaggtgtacaataaaagaggcagccaagtagcaacgtatttctgagttgcaattacttgcctccactgtgagagaaaccccagccacatctacagcacacaagaacttcaaaatgcctgaaccacagtggccaggcattcctccaggactgcctcccccaggatcttgcttcaagtgctggaaatctggccactgggccaaggaatgcccacagccaaggttttctcctaagccatgtcccatctgtgtgggaccccactggaaatcggactgtccaactcacctggcagccactcccagagcccctggaactctggcccaaggctccctgactgactccttcccggatcttctcagcttagcggctgaagattgatgctgcccaattgccttggaagcctcctggaccatcacagacactttgggtaactcttacaatgaagagtaggtctgtcctcttcttaatcaatatggaggctacccactccacattaccttcttttcaagggcctgtttcccttgcctccataactgctgtggtattgacggccaggcttctaaacctcttaaaactccccaactctggtgccaatttagacaatattcttttatacactcctttttagttatccccacctgcccagctcccttattaactcaagatattttaactaaattatctgcttccctgactattcctgtacgacagccacaccttattgccacccttttccccagttcatagcctcctttgcatcctccccttgtgtctccctaccttaatccacaagtatgggacacctctacttcctccttggtgacccatcaggcatgccttacgatcccattaaaacctaatcactcttacctggctcaatgccagtaccacatcccacaacagactttacgaggactaaagcctgctatcacttgcctgttacaacacggccttttaaagcctacacattctccttacaactcccctaccccacctgtccagaaactggacaaatcttatgggctagttcaggatattcaccttatctgcagcacctcttacaaatcttcccaacaggacacactcctgctcctccaatatctattctcaaagggatatcacatatccccctccaaagcctaagtttcttcctcatctattacctatctctgcataattcttcataaaaacacatgtgctctccctactgattgtgtgtggctaatctccaaacctcaaccccttctacaaaacaacagctcttttcctcgtaggcatggctaggtacttttgcctttggatacctagttttaccatcctgactaaaccattatataaactcacagaaggaaacatagctgaccccatacatcctaaatcctttctccactcctttctccattccttaaaaacagccctagaagctgcttccacactagctctccctaactcatcccaactcttttcattacacacagccaaagtacagggctatgcagttggaattccttacacaaaagccaggaccgagccctgtagcctttctgtccaaacaacttgacctcacagttttgggcaagccctcatatctctgtgtggcaaagggactatgtgtcaatatctacactgattccaagtatgtcttccacatccttcaccaccatgctattacatgggcagaaagaagtttcctcactacacaagggtcctccatcattaatacctctttaataaaaactcttctcaaggctgctttacttccaaaaaaaaaaaaaagctggagtcattcactgcaaaggccattaaagggcctcagaccccattgctcaaggcaacaattatgctgataagatagctaaaaaagcagccaatattcctacttctgtccctcatggccagtttttctcctcatcagtcactcctatttactctcccactgaagtttccacctatcgatccctcaccactcaaggcagatggttcttagaccaaaaaagaatctccttccagcctcacaagcccgttctattctgtcgtcatttcattacctcttccatgtaggttacaagccgctagcccacctcttagaaccaacctctcatttcctttccatcataggactctatcctcaatgaaatcacttctcagtgtttcatctgctattctactactccttggggattgttcaggccccctctcttccctacacatcaagctcagggatttgcccctgcccaggactggcaaattgactttattcacatgcccctagtcaggaaactaaaatacctctttgtctgggtacatactttcactagatgggtagaggcctttcccacatggtctgaaaaggccacagtggtcatttcttcccttctgtaagacataatacctcggtttggccttcccacctctatacagtccaataatggaccggactttattagtcaaatcagctaagcagtttctcaggctcttggtattcaatggaaatttcataccccttaccgtcctcaatcttcaggaaaggtagaacgggactaatggtcttttaaaaacacacctcaccaagctcagcctccaacttaaaaaggaggactctgtcaaggatagagccccaaaattcaccaaccaagcaagatattatgctgaacccccttgggcactctctaattggatgtcctgggtcctcccaattcttagtcctttgatacctgtttttctccttctcttatttggaccttgtgccttctgtttagtttctcaattcatacaaaaccgcatccaggcgatcaccaatcattctgtatgacaaatgctccttctaacaaccccacaatatcaccccttaccacaaaatcttccttcagcttaatttctcccactctaggttcccatgccaccccaatcctgctcgaaacagccatgaaaaaaatcgcccattatctctccatatcaccccccaaaattttcactgccccaatgcttcaacactattttgttttatttttcttatttttcttattaatataagaagacaggaatgtcaggcctctgagcccaagctaagccatcatatcccctgtgacctgcacgtatacatccaaatggcctgaagcaactgaagaatcacaaaagaagtgaaaatggctgattcctgccttaattgatgacattccaccattgtgatttgttcctaccccacctaaactgagcaattaaccttgtgaaattccttctcctggctcagaagctcccccactgagcaccttgtgactcctgccccttcccaccagagaacaacccctttgactgtaattttctgctactacccaaatcctataaaactgcccaacccctatctcccttcgctgactcctttttcggacttagcccacctgcacccaggtgatcaaaaagctttattgctcacacaaagcctgtttggtgacctctgcacatggatgtgcatga

SEQ ID NO: 715 - DNA, 438 bp, Homo sapiens
gtcaggcctctgagcccaagttaagccatcatatcccctgtgacctgcatgtatacatccagatggcctgaagtaactgaagaaccacaaaagcagtgacaatagccaattcctgccttaactgatgacattccaccattgtgatttgttcctgccccacccaaactgatcaattgaccttgtgacattccttctcctggacaatgaatctcagagctctccacagagcaccttgtgacccccaccccctgcttgcaagagaaaaaccacctttaactgtaattttccactacttacccaaatcctataacactgcaccacccctatctccctttgctgactcctttttcggactcaggacacttgcacccaggtaattaaaagctttattgctcacacaaagcctgtttgctggtctcttcaaacggatgcacgtaa

SEQ ID NO: 716 - DNA, 708 bp, Homo sapiens
gcaggcagtcaggcagacatgagcacagcaggagaggacacccccactccaaacccagcaatgtcaggcagccagcaggtgatgggcaggcgggtggctgttaagctgtctctctaaaatataattggtcacagccagtgccagggaaaggcagtttccccatagacaggaaaaacctgaaactggtgatcagcagcttcccaataagacctcaggagttgggtgagtgggctcaagcatgcaccctaagaggcaaaatggctgagtttcactggtctatgaccttcctctaggaaaacttgactggtaagggaagaacacctcaagtgagcatgcatacaatttcaggaaacacactgtgcatgcggcccctcccagatgctggaaggccactgtgcatgtggacagcccaccccatgggaagaatcaggggagaagggatgcaaccctccggaagcaggccaacctataaaaccccaagtccaaggtcaaactgcacttgatctctgaagtcgctgtgtggtcctcttccaagtgtactttacttcctttcattcctgctgtaaagcttttgaataaactttcattcctgctctaaaacttgcctcaatctcttcctgtgccttatgctccttggtagaattatttcttccgaggagacaagaattgaggttgctgtagactcatgtggatttgctgctgctaaaa

SEQ ID NO: 717 - DNA, 668 bp, Homo sapiens
ttacagtaggtagtaacaaggcttgagcggggcaggagggagctctccctgctctccaccaggaatgtcgggccaccatcaggtgatgggcaggtggttgttaactgcctctctaaaataataactggtcacagccagcgccaggaaaaggcagtctcccaatagatagaaaaaaaacctgaaactggtgatgcaatcagcaggagttcagggagtggactcaagcatgagctttaagaagcaaaatggcagagtttacttgttatatgaccttctaggttcattcgatttgtaagggaagaatgcctcacctgagcacgcatacaagtccagtaaacacactgcacttgctcacctcccaagtgccagcagcccactgcacatgcagacagcccaccccaaggcaagaatcaggggagaagagatgcaagaccctagaaatatgccaaccccaagtcagaaggtcaaatagggcacttgatctctcaagtcacccgcttggccttcttccaagtgtattttatttcctttcattccttcgctaaagcttttatgataaacttttactcatgctctattgcctccatctctcctgcgttctgcctccttggttgaattctttctttggaggaggcaagaactgaggttgctgcagacccatacggatt

SEQ ID NO: 718 - DNA, 358 bp, Homo sapiens
actgaagaaccacaaaagaagtgaaaatagccaattcctgcctttactgatgacattccaccatcatgatttgttcctgccccaccctaattaaccagttgaccttgtgacattccttctcctggacagtgaatctcaggagctccccactgagcaccttatgacctgcccctgcctgcaagagaaaaaacccctttaactgtcattttccactacctacccaaatcctataaaactgccccacccctctctccctttgctgactcccttttcggacttggtctgcctccacccaggtgattaaaaagctttattgttcacacaaagcctgtttggtggtctcttcacatggacacgc

SEQ ID NO: 719 - DNA, 682 bp, Homo sapiens
ttagagttggtatttaggcagacatgagcagggcagaagagggccccctgccccagggatgtcaggtgaccatcaggtgatagccaggttgttgttaagctgtctctaattggccatgcctggcactagggaaaggctgtcttccagtagacaggaaacatctgaagctggtgatcagcttcctgataggatctcaggagctggatgagtgggcccaagtatgtgcactaaatggcaaaatggcagagtttaactggtatgtgaccttcctctaggaatgcttacctggaaagggtaatgatcttgcacacaatttcagcaaacacactgtgcatgctcctctcccaagtgctggcaggccactgcatgggagcagcctgctgcaagggaagaatcagggaagaagaaatgtggaccctggagtcatgtcatacaagaccccacccaagtcgagggtcagacagagcacttgaatctctcaagtcgcctgcttggccctttccaactgtactttactccctttcattccttctctaaaactttttagtaaacttttactcctgctctaaaacttgcctcagtctctcaccctgcctgctgccccttggctgtattctttcttctgcaaggcaagaattgagttgctgcagacttgtacagatccacccctgctaacaagact

SEQ ID NO: 720 - DNA, 3258 bp, Homo sapiens
tacactagctctccgtgactcatcccaacccttttcattacacacagctgaagtgcagcgctgtgcagttgaaattcttacacaaggaccaggatggcatcctgtagcctttttgtccaaacaacttgaccttattgttttaggttggctgttatgtctctgtgcagcagctgctgccatcctaatactttaaaggcccttaaaatcacaaactatgctcaactcactctctacagctctcataatttccaaaatgtattttcttcctcacacctgccacatatacattctgctccccggctccttctgctgtactctttgttgagtctcccacaattaccattgttcctggcccggacttcaatccagcctcccacattattcctgataccacacctgaccctcatgactgcatctctctgatccacctgacattcaccccatgtccccacatttccttcttcccagtttctcaccctgaccacacttagtttattgatggcagttccaccaggcctaattgccacacaccagcaaaagcaggctatgctatagtacaagccactagcctgcctcttagaacctctcatttcctttccatcgtggaaatctatcctcaaggaaataacttctcagtgttccatctgctattctactactcctcagggattcttcaggccccctcccttccctacacatcaagctcagggatttgcccccacccaggactggcaaattagctttactcaacgtgccccgagtcaggaaactaaaataactcttggtctaggtagacactttcactggataggtagaggcctttcccacagggtctaagaaggccaccacggtcatttcttcccttctgtcagacgtaattcctcagtttggctttcccacgtctatacagtcccatagcagaccggcctttattaatcaagtcagccaagcattttttcaggctcttagtattcagtgaaacctttatatttcttacagtccttagtcttcaggaaaggtagaacagactaatggtcttttaaaacacaccttaccaagctcagccaccaacttaaaaaggactggacaatacttttaccactttcccttctcagaattcaggcctgtcttcggaatgctacaaggtacagcccatttgttgcgggaagtcagggaccccaaacggagggaccggctgaagccatggcagaagaacgtggattgtgaagattttatggacatttattagttccccaaattaatacttttgtaatttcttatgcctgcctttactgcagtctctaaacataaattgtaaagattccatggacacttatcacttccccaatcaatatccttgtgatttcctatgcttgtctttgctttaatctcttaatcctgtcagccgagaagaatttatatcatctcaggaccctgtaataattgtattaactacacaaattgtacagcatgtgtgtttgagcaatatgaaatgtgggcaccctgaaaaaagaacaggataacagcaattgttcagggaataagagagataaccttaaactctgaccgccggtgagccgggcagaacagccatatttctcttctttcaaaagcaaatgggagaaatatcgctgaattccttttctcagcatggaacgtccctgagaaagagaatgcacacctaggggtaggtctctgaactggctccccgccgggcgtacctgtctcttatggtcgagattgcagaggtgaaataaactccagtctcccatagtgctcccaggcttattaggaagaggaaattcccgcctaataaactttggtcagaccggttgatctcaaaaccctgtctcctgataagatgttatcaatgacaatggtgccaaaacttcatcaacaattttaacttcacttcggtcctgtggtcctatgatcttgccctgtctccacttgccttgtgatattctattaccttgttaagtacttgatgtctgtcacccacacctattcgtatactccctccccttttgaaactccctaataaaaacttgctggtttttgtggcttgtggggcatcacggatcctaccaatatgtgatgtctcccccggatgcccagctttaaaatttctcttttttgtactctgtccttttatttctcaagccagttgacacttaggaaaatagaaaagaaactacgtgattatcggggcaggtcccccgatacccattggatctcctgtatagacgctcctttttattaggcccaagtctcattccagacacaagaccaacttggactgtgccccaaaaaacttgtcatccctactatcttctgtctagtcatactcctattcaccgttctcaactactcatatatgccctgctcttgtttacactggtggtttacactgtttctccaagccatcacaggtgatatctcctggtgctatccccaaaccaccactcttaactcttaaataaataatctttgctggcaaggctatgctgaacctccttaggcactctctaattagaggtcctaggtcctcccaattcttcgtcctttaatacctgtttttctccttctcttattccgtttagtttttcaattcatacaaaactgtatccaggccatcaccaataattctaaataacaaccccacaatatcaccccttaccacaaaatcttccttcagcttcatctctcccactcgaggttcccacgctgcccctaatcaaagcagccctgagaaacatcgcccattatctctccataccacccccagaaatttttcaccatcccaacactttaccactatttcattttatttttcttattaatgtacgaagacaggaacgtcaggcctctgagcccaagctaagccatcatatcccctgtgacctgcatgtacacatccagatggccgatttctgccttaactgatgacattccaccacaaaagaaatgaaaatggcctgttcctgccttaactgatgacattatcttgtgaaattccttctccttgctcatcctggctcaaaagctcccctactgagcaccttgtgacccccactcctgcctgccagacaacacccctttttcctttacctacccaaatctgataaaacggccccacccctatctcccttcgctgactctttttggactcagcccacctgcacccaggtgaaataaacagctttattgctcacacaaagcctgttttgtggtctcttcacacggatgcgcatgaaa

SEQ ID NO: 721 - DNA, 457 bp, Homo sapiens
gtcaggcctctgagcccaagctaagccatcatatcccctgtgacctgcacctatacatccagatggcctgaagtaactgaagaatcacaaaagaagggatatttaaatggtctgttcctgccttcactgatgacattccaccacaaaagaagtgaaaatggccggtccttgccttaactgatgacattaccttgtgaaattccttctcctggctcatcctggctcaaaaagctccccaactgagcaccttgtgacccccactcctgcccgcctgagaacaactcccccctttgactgtaattttcctttacctacctaaatcctataaaacgaccccacccatatctcctttggctgactctcttttcagactcagcccgcctgaacccaggtgaaataaacagccttgctcacacaaagcctgtttggtggtctcttcacatggacgcgagtgaaa

SEQ ID NO: 722 - DNA, 5831 bp, Homo sapiens
gtcaggactctgagcccaagctaagccatcatatcccccgtgacctgcacatacgcatccagatggctggtttctgccttaactgatgacattccaccacaaaagaagtgaaaatggcctgttcctgccttaactgatgacattatcttgtgaaattccttctcctggctcatactggctcaaaagctcccctactgagcaccttgtgacccccaactcctgcccgccagagaacaactccccttttcctttacctacccaaatcctataaaatggcaccacccctatctccccttgctgactctcttttcggactcagcccacgtgcacccaggtgattaaaaggtttattgctcacacaaagcctgtttggtggtctcttcacatggacgcacatgaaatttggtgccgtgactaggatcgggggacctcccttgggagatcaatcccctgtcctcctgttctttgctccgtgagaaagatccacctacaacctcaggtcctcagaccaaccagcccaagaaacatctcaccaatttcaaatctggtaagcggcctcattttactctcttctccaacctccctcactatccctcaaccactttctcctttcaatcttggcaccacacttcaatctctcccttctcttaatttcaattcctttcattctctggcagagacaaaagagacacgttttatccatggacccaaaactccggcgccggtcaccggcaagaaccccatcccttctctccgtgtctctaccccttctctgcttttctgggggaggggcatgaacccctcaaccccttctccttcacccttagtggcaagtcccacttttctgggggagaggcaagaacccctcaagcccttctcctgcacccttagcggcaagtcccgcttttctgggggaggggcaagaacccctcaactcctcctccttcaaccttagcggcaaatccttcttctctgggggaggggcaggaaccctgacatcttatctctgtgccccaatctcttatttctgcaccccgacctcttatctctgtgccccaaccccttatttctgcgccccacccccttctctgcttttctggagggcaagaacccctcaccccttctctatgtcttgactctcttttctctgggcttgcctcctccactatgggaaagcttccgccttccattcctccttttctcccttagcctgtgttcttaagaacttaaaacctcttcaactctcacctgacctaaaatctaagcatcttattttcttctgcaatgccacttgaccccaatacaaactcaacagtagttccaaatacccggaaaatggccctttcaatttttccatcctacaagatctaaataatttttgtcataaaataggcaaacgatctgaggtgcctgacattcaggcattcttttacacattggtccctccctagtctctgttcccaatgcaactcatcccaaatcttccttctttccctcccacctgtcccctcagtcccaaccccaagcatcactgagtctttctgatcttccttttctacagacctctcccctcctcgccaggccaagctaggtcccaattcttcctcagcctccgctcctccaccctataatccttttatcacctcccctcctcacacctggtccggcttacagtttcgttccatgactagccctcccccacctgcccagcaatttactcttaaaaaggtggctggagctaaaggcatagtcaaggttaatgctcctttttctttatcccaaattagatagcgtttaggctctttttcatcaaatataaaaatccagcccagttcatggctcgtttggcagcaaccctgagatgctttacagccctagaccctaaaaggtcaaaaggccgtcttattctcaacatacattttattacccaatctgctcccaacattaaataaaactccaaaaattaaattccggccctcaaaccccacaacaggacttaattaacctcaccttcaaggtgtacaataatagagtcgaggcagccaagtatcaacatatttctgagttgcaattccttgcctccactgtgagacaaaccccagccacatctccagcacacaagaacttccaaacgcctaaaccgcagtggccaggtgttcctccagaaccgcctcccccaggagcttgctacaagtgtcagaaatctggccaccaggccaaggaatgcccacagcccgggattcctcctaagctgtgtcccatctgtgtgggaccccactggaaattggactgttcaactcacctggcagccactcccagagcccctggaactctggcccaaggctctctgactgactccttcccagatcttctcggcttagcagctgaagactgacactgcctgatcacctcagaagccctgtagaccatcatggatgccgagcttcaagtaactctcacagtggagggtaagtccctccccttcttaatcaatacggaggctaccgactccacattaccttcttttcaagggcctgtttcccttgcctctgtaactgttgtgggtgttgacagccaggcttctaaacctcttaaaactccccaactctggtgccaacttagacaatactcttttaagcactcctttttagttatccccacctgcccagttcccttattaggctgagacactttaactaaattatctgcttccctgactattcctggactacagctacatctcattgccgcccttcttcccaatccaaagcctcctttgcatcctcctcttgtatcccctcaccttaacccacaagtataagatacctctgctccctccttggtgaccgatcatgcaccccttaccatctcattaaaacctaatcacccttaccccattcaatgccaatatcccatcccacagcatgctttaaaaggattaaagcctgttatcacttgcctgctatggcatggccttttaaagcctataaactctccttacaattcccccattttacctgtcctaaaaccagacaagcctcacgaattagttcaggatctatgccttatcaaccaaattgttttggctatccaccccatggtgccaaacccatatactctcctatcctcaacacctccctccacaatccattattctgttctggatctcaaacatgctttccttactatttctttgtaccctgcatcccagcctgtctttgctttcacctggactgaccctgacacccatcaagctcagccaattacctaggctgtactgctgcaaagcttcacagacagcccccattacttcagtcaagcccaaatttcttcctcatctgttacctatttcggcataattctcataaaaacacatgtgctctccctgctgatcgtgtcagctaatcttccaaaccccaatcccttctacaaaacaaaaactcctttccttcctaggcatggttggatactttcacctttggatacctggttttgctatcctaatgaaaccattatataaactgacaaaaggaaacctagctgaccccatagatcctaaatcctttccccactcctctttccattcctttaagacagctttagagactgcccccaccctacctctctctgactcatcccaacccttttcattacgcacagccgaagtgcagggctgtgcagttggaattcttacacaaggactgggaacgcgccctgtaacctttttgtccaaacaacttgaccttactgttttaggctggccatcatgtctccatgcagctgcagctgccactctaatacttttagaggcccttaaaatcacaaactatgctcaactcactctctacagctctcataatttccaaaatctattttcttcctcacacctgatgcatatactttatgctccccggctccttcagctgtactcactctttgttgagtctaccacaattaccattgttcctggcccagatttcaatccggcctcccacattattcctgataccacacctgaccctcataactgcatctctctgatccacctgacgttcaccccatttccccacatttccttctttcctgtttctcaccctgctcacacttggtttattgatggcagttccaccaggcctaatcaccacacaccagcaaaggcaggctatgctatagtacaagccaccagcccgcctcttagaacctctcatttcctttccattatggaaatctatcctcaaggaaataacttctcagtgttccatctgctattctactactcctcagggattattcaggctccctcccttccctacacatcaagctcagggatttgcccccacccaggactggcaaattagctttactcaacatgccctgagtcaggaaactaaaatacctcttggtctaggtagacactttcactggataggtagaggcctttcccacaggttctaagaaggccaccatggtcatttcttcccttctgtcagacataattccttggtttggccttcccacctctatacagtccgataacagaccagcctttattagtcaaatcacccaagcattttttcaggctcttagtattcggtgaaaactttatatcgcttacagtcctcagtgttcaggaaaggtagaacagactaatggtcttttaaaaacacacctcatcaagctcagccaacaactgaaaaaggactaggcaatacgtttacctctttcccttctcagaattcaggcctgtccttggagtgctacaaggtacagcccatatgagctcctgtatagatgctcctttttattaggccccagtctcattccagacaccagaccaacttggactgtgccccaaaaaacttgtcaaccctactatcttctgtctagtcatactcctattcaccattctcaactactcatacatgccctgctcttgtttacgctgccagtttacactgtttctccaagacatcacagctgatatctcctggtgctatccccaaaccgccactcttaactcttaaagtaaataaataatctttgctggcaaggctatgcgaacctccttaggcactctctaattagatgtcctaggtcctcccaattcttagtccttaaatacctgtttttctccttctcttattccgtttagttttttaatgcatacaaaactgtatccaggccatcaccaataattctaaatgacaaatgtttcttctaacaacctcacaatatcaccccttaccacaaaatctttcttcagcttaatctctcccactctaggttcccacgccgcccctaatcccgctcgaagcagccctgagaaacattgtctattatctcttcataccaccccccaaaaattttcaccgtcccaacactttaccactatttcattttctttctcttattaatataagaagacaggaatatcagacctctgagcccaagctaagccatcatatcccctgtgacctgcacgtacacatccagatggccggttcctgccttaactgatgacattccaccacaaaagaagtgaaaatggcctgttcctgccttaactgatgacattatcttgtgaaattccttttcctggctcatcctggctcaaaagctcccctactgagcaccttgtgacccctactcctgcccgccagagaacaactcctcttttcctttacctacccaaatcctataaaacggccccacccctatctccctttgctgactctcttttcggactcagcccacctgcacccaggtgattaaaaggtttattgctcacacaaagcctgtttggtggtctcttcacacggacgcgcatgaaa

SEQ ID NO: 723 - DNA, 5191 bp, Homo sapiens
gtcaggcctctgagcccaagccaagccatcgcatctcctgtgacttgcacctatacgcccagatggcctgaagtaactgaagaatcacaaaagaagtgaaaaggccctgccccgccttaactgatgacattccaccattgtgatttgttcctgccccaacttaactgaatgattaaccctgggaatttccttctcctggctcagaagctcccccactgagcaccttgtgacccccgcccctgcccaccagagaacaaccccctttgactgtaattttccattaccttcccaaatcctataaaacggccccacccctatctccctttgctgactctcttttcggactcagcccacctgcacccaggtgaaataaacaaccatgttgctcacacaaagcctgtttggtggtctcttcacacggacgcacatgaaatttggtgccgtgactcggatcgggggacctcccttgggagatcaatcctccgtcctcctgctctttgctccatgagaaagatccacctacgacctcaggtcctcagactgatcagcccaagaaacatctcaccaatctcaaatccggtaagtggcctctttttactctcttctccaacctccctcactatccctcaacctctttctcctttcaatcttggcgccacacttcaatctctcccttctcttaatttcaattcctttcattttctggtagagacaaaggagacacgttttatccgtggacccaaaactccggcgccggtcacggactgggaaggcagccttcccttggtgtttaatcattgcagggacacctctctgattatacactcacatttcaagggtgtcagaccacacagggacgcctgccttggtccttcacccttagtggcaagtcccgcttttctggggaagggtcaagtaccccaaccccttctcttgtctctaccccttctctgcttttctggggcaggggcaagtacccctcaaccccttctccttcacccttagcggcaagtcccgctttcctagggggcaagaaccccccaatcccttatttccacaccccaacctcttatctctgcgccccagtcccttatttccacgccccaacctcttgtctctgcgccccaatcccttatctctgcgccccaatcccttatttccacaccccaacctcttatctctgcgccccagtcccttatttccacgccccaacctcttatctctgcgtcccaatcccttatttccacgccccaacctcttatctctgcgccccaatcccttatctctgcgccccaatgccttatttccgcgccccgacccccccctcccgcttttctggaaggtaagaacccccgaaccccttccctccgtgtctctacgctctcttttctctgggcttgcctccttcactatgggcttgcctccttcactatgggcaagcttccaccttccattcctccttcttctcccttagcctgtattcttaagaacttaaaacctcttcaactctcacctgacctaaaatctaggcgtcttattttcttctgcaatgccgcttgaccccaatacaaactccacagtagttccaaatagccggaaaacggcactttcaatttttccatcctacaagatctaactaattcttgtcgtaaaatgggcaaatggtctgagatgcctgacgtccaggcattcttttacacatcagtccattcctagtctctgtgcccaatgcaactcgtcccaaatctcccgcctgtcccctcagtcccaaccccaagcgtcgctgagtctttctaatcttccttttctacagacccatctgacctctcccctcctcgcctggccaagctaggtcccaattcttcctcagcctccactcctccaccctataatccttttatcgcctcccctcctcacacctgctccggcttacagtttcattccgtgactagccctcccccacctgcccagcaatttactcttaaaaaggtggctggagctaaagacatagtcaaggttaatgctcctttttctttatcccagatcagatagcgtttaggctctttttcaccaaatataaaaacccagttcatggctcgtttggcagcaaccctgaggcgcttcacagccccagaccctaaaaggtcaaaaggccgtcttattctcaatatacattctattacccaatctgctcccgacattaactccaaaaattggaatctggccctcaaaccccacagcaggacttaattaacctcaccttcaaggtgtacaataacagaaaaaagttgcaattccttgcctccactgtgagacaaaccccagccacatctccagcacacaagaacttccaaacgcctgaactgcagcagccaggcgttcctccagaacctcctcccccaggagcttactacaagtgccagaaatctggccaccaggccaaggaatgcctgcagcccaggattcctcctaagccgtgtcccatctgtacgggaccccactggaaatcggactgttcaactcacctggcagacactcccagagcccctggaactctgacccagggctctctgactgactccttcttggcttaccggctgaaaactgacgctgcctgatcgcctcggaagccccgtagaccatcacggacgccgagctttaggtaactctcacagtggaaggtaagtccgtccccttcttaatcaatatggaggctacccactccacattaccttcttttcaagggcctgtttcccttgcctccataactgttgtgggtattgacagccaggtttctaaacttcttaaaactccccaactctggtgccaacttagacaacactcttttatgcactcttttttagttatctccacctgcccagttcccttattaggccgagatattttaaccaaatgatctgcttccctgactattcctggactacagccacatctcattgctgcccttcttcccaatccaaagcctcctttgcgtcctcctcttgtatcccccaccttaacccacaagtataagatacctctactccctccttggtgaccgatcatgcaccccttaccatctcattaaaacctaatcacccttaccccgctcaatgccaatatcccatcccacagcatgctttgaaaggattaaagcctgttatcactcgcctgctacagcatggccttttaaagcctataaactctccttacaattcccccattttacctgtcctaaaaccagacaagccttacaagttagttcaggatctatgccttatcaaccaaattgttttgcctatccaccctatgatgccaaacccatatactctcctatcctcaatacctccctccacaatccattattctgttctggatctcaaacgtgctttctttactactcctttgtacctgtcatcccagcctctcttcgctttcacttggactgaccctgacactcatcaggttcagcaaattacctgggctgtactgccgcaaggcttcacagacagcccccattacttcagtcaagcccaaatttcatcctcatctgttacctatctcggcataattctcgtaaaaacacacgagctctccctgctgatcgtgtctgattaatctcccaaacctcaatcccttacaaaacaacaaactcctttccttcctaggcatggttaatgcagtcagaattcttacacaagagccaggaccgcaccctgtagcctttctgtccaaacaacttgaccttactgttttagcctagccctcatgtctgcgtgcagcggctgccgctgctttaatacttttagaggcctttcctacaaggtctgagaaggccaccgtagtcatttcttcccttctgtcagacataattcctcagtttagccttcccacctctatacagtctgataacagaccagcctttattagtcaaatcagccaagcattttttcaggctcttagtattcagtgacagactaatggtctattaaaaacacacctcaccaagctcagccaccaacttaaaaaggactggacaatacttttaccactttcccttctcagaagtcagacctgtcctcagaatgctacaaggtacagcccatttaagctcctgtatagacgctcctttttattaggccccagtctcattccagacaccagaccaacttcgactatgcccccaaataacttgtcatccctactatcttccgtctagtcatactcctattcaccattctcaactactcatacatgccctgctcttgtttacactgccggtttacactgtttctccaagccatcacagctgatatctcctcgtcctatccccaaactgccactcttaactcttgaataaataatctttgctggcaggactatgctgaacctccataggcactctctaattagatgtcctaggtcctcccaattcttagtccttttatacctgtttttctccttctcttattccacttagtttttcaattcatacaaaaccgtatccaggccatcaccaatcattctatacgacaaatgtttcttctaacaaccccacaatatcaccccttaccacagatctcccttcagcttaatctctcccactctaggttcccacaccgcccctaatcctgcttgaagcagccctgagaaacatcacccattctctctccataccaccccccaaaaattttcgccgccccaacacttcaacactattttgttttatttttcttattaatagaagaaggcaggaatgtcaggcctctgagcccaagccaagccatcgcatcccctgtgatttgcacctatacgcccagatggcctgaagtaactgaagaatcacaaaagaagtgaaaaggccctgccccgccttaactgacgacattccaccattgtgatttgttcctgccccaacttaactgagtgattaaccctgggaatttccttctcctggctcagaagctcccccactgagcaccttgtgacccccgcccctgcccaccagagaacaaccccctttgactgtaattttccattaccttcccaaatcctataaaacggccccacccctatctcccttcgctgactctcttttcggactcagcccacctgcacccaggtgaaataaacaaccatgttgctcacacaaagcctgtttggtgttctcttcacacggacgcgcatgaaa

SEQ ID NO: 724 - DNA, 354 bp, Homo sapiens
ccacaaaagaagtgaaaacagccagttcctgccttaactgatgacattccaccatagagatttgttgctgccccaccctaatgatcaattgtccttgtgacattccttctcctggacaatgaatctcaggagctccccactgagcaccttgtgacccctgcccctgcccacaagagaacaatcccctttaactgtaattttccactacctacccaaatcctgtaaagctgccccacacctgtctccctttgctgactcctttttcggactcagtccgcccgtacccaggtgattaaaaagctttattgctcacacaaagcctgtttggcagtctcttcacacggacacgcataa

SEQ ID NO: 725 - DNA, 5924 bp, Homo sapiens
gtcaggcctctgagcccaagccaagccatcacatcccctgtgacttgcacctatacgcccagatggcctgaagtaactgaagaatcacaaaagaagtgaatatgccctgccccaccttaactgatgacattccaccacaaaagaagggtaaatggccagtccttgccttaagtgatgacattaccttgtgaaagtccttttcctagctcatcctggctcaaaaagcacccccactgagcaccttgccacccccactcctgcccgccagagaacaaacctcctttgactgtaattttcctttacctccccaaatcctataaaacggccccacccttatctcccttcactgactctcttttcggactcagcccacctgcactcaggtgaaataaacagccatgttgctcacacaaagcctgtttggtggtctcttcacacggatgctcatgaaatttggtgctgtgactcagatcgggggacctcccccgtactcctactctttgctccgtgagaaagatccacctatgacctcaggtcctcaaaccgaccagcccaagaaacatctcaccaatttcaaatccagtaagcggcctctttttactctcttctccaacctccctcactatccctcaacctctttctcctttcaatcttggcgccacacttcaatctctcccttctcttaatttcaattcctttcattttctggtagagagaaaggagacacattttatccgtggacccaaaactccggcgccggtcacagactgggaaggcagccttcccttggtgtttaatcattgcagggatgcctttctgattatacacccacatttcaagggtgtcagaccatgcagggacacctgccttggtccttcacccttagcggcaagtcctgcttttctggggaaggggcaagtaccccaatgccttctctccttgtctctaccccttctctgcttttccggggacagggcaagtaccccaagcccttctctccttgtctctaccccttctctgcttttctgggggaggggcaagtacccctcaaccccttctccttcacccttagcggcaagtcccgcttttttgggagagggggcaagtacccctcaaccccttctccttcactcttagtggcaagttccacttttctagaggcgcaagtaccccaacctcatatctctgtgccccaatcccttatttccacgccccaacctcttatatctctgcacctcaatcccttatttccgtgccccaacctcgtatctctgcaccccaatcccttatttctgtgccccatcccttatttccatgccccaacctcttatctctgcaccccaaccccttttccaacttttctggaaggtaagaacccctgaaccccttccctccatttctctactctctcttttctctaggcttgctttcttcactatgggaaccttccaccctccattcctccttctactcccttggcctgtgttctcaaaaacttaaaacctcttcaactcacacctgacctaaaacctaaatgccttattttcttctgcaatgccgcttgaccccaatacaaactcaacagtagttccaaatagccagaaaatggcactttgaatttttccatcctgcaagatctaaataattcttgttgtaaaataggcaaacggtctgagatgcctgacgtccaggcattcttttacacatcagtcccttcctagtctctgtgcccagtgcaacccgtcccaaatcttccttctttccctccttcctgtcccctcagtcacaaccccaagcatcgctgagtctttctaatcttccttttctacagacccatctgacttctaccctccttgccaggccaagctaggtcccaattcttcctcagcctctgctcctccaccctataatctttttatcacctctcctcctcacacctggtccaacttacagtttcgttctgtgactagccctcccccacctgcccagcaatttactcttaaaaaggtggctggagctaaaggcatagtcaaggttaatgctcctttttctttatcccaaatcagaagcgtttaggctctttttcatcaaatataaaaatccagcccagttcatgacttgtttggcagcaaccctgagacactttacagccctagaccctaaaaggtgaaaaggccgtcttattctcaaaatacattttattacccgatctgctcccgacattaaataaaactccaaaaattaaattctggcccccaaacccaacaacaggatttaattaacctcgccttcaaggtgtacaataatagaaaaaagttgcaactccttgccttcactgtgagacaaaccccagccacatttccagcacacaagaacttccaaatgcctgaaccgcagcggccaggcattcctccagaacctcctcccacaggagcttgctacacatgccagaaatctggccactgggccaaggaatgcccgcagcccgggattcctcctaagctgcgtcccatctgtgtgggaccccactgaaaattggactgttcaactcacctggcagccactcccagagcccctggaactctggcccaaggctgtctgactccttcccagatcttctcagcttagcggctgaagactgacactgcccgattgccttggaagccccctagaccatcatggacaccgagctttgggtaactctcacagtggaaggtaagcccatccccttcttaatcaatacggaggctacccactccacattaccttcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggctgagacactttaactaaattatctgcttcccggactattcctggactacagctatatctcattgcctcccttcttcccaatccaaagcctcctttgcgtcctcctcttgtatctctccaccttaacccacaagtataagatacctctactccctccttggcaaccgatcatgtaccccttaccatctcattaaaacctaatcacccttaccccactcaatgccaatatcccatcccaaagcacgctttaaaaagattaaagcctgttaccactcgcctgctacagcatggccttttaaagcctataaactctccttacaattcccccattttacctgtcctaaaaccagacaagccttacaagttagttcaggatctgcgccttatcaaccaaattgttttgcctatccaccccgtagtgccaaacccatatactctcctatcctcaatacctccctccacaacccattattctgttctagatctcaaacatgctttctttactattcctttgcacccttcatcccagcctctcttcgctttcacttggactgaccctgacacccatcaagctgagcaaattacctaggctgtactgccgcaaagcttcacagacagcccccattacttcaatcaagcccaaatttcttcctcatctgttacctatctcggcataattatcataaaaacacacgtgctctccctgccaatcgtgtccaactgatctctcaaacccaagcaccttctacaaaacaacaactcctttccttcctaggcaaggttagcacggtcagaattcttacacaagagccaggaccacaccctgtagcctttctgtccaaacaacttgaccttactattttagcctagccctcatgtctgtgtgcagcagctgccgctgctttaatattttagaggccctcaaaatcacaaactgtgctctactcactctctacagttctcataacttccaaagtctattttcttcctcatacctgacgcatatactttctgcttcccggctccttcagctgtactcactctttgttgagtctcccacaattaccattgttcctggcccagacttcaatctggcctcccacattattcctgataccacacctgacccccatgactgtatctctctgatccacctgacattcacatttccccaaatttccttttttcctgttcctcaccctgatcacgcttgatttattgatggcggttccaccaggcctaatcgccatacaccagcaaaggcaggttatgctatagtacaagccactagcccacctcttagaacctctcatttcctttccatcgtggaaatctatcctcaagaaaataacttctcagtgttccatcttctattctactactcctcagggattattcaggccccctcccttccatacacatcaagctcgaggatttgccccacccaagcctggcaaattagctttactcaacatgtcctgagtcagataactaaaatacctcttatctaggtagacactttcactggataggtacaggcctttcctacagggtctgagaaggccaccgcagtcatttcttccattctgttagacataattcctcagtttaggcttcccacctcaatacagtctgataacagatgagcctttattagtcaaatcagccaagcagtttttcaggctcttagtattcagtgaaacctttacatcccttatggtcctccatcttcaagaaaagtagaatggactaaaggtcttttaaaaacatacctcaccaagctcagccaccaacttaaaagggactggacaatacttttaccactttcccttctcagaatgcaggcctgtcctcagaatgctacagggtacagcccatctgagctcctgtacagacgctcctttttattaggtcccagtctcattccagacaccagaccaacttagactgtgccccaaaaaaacttgtcatccctcctatcttctgtgtagtcatactcctattcaccattctcaactactcatacaggccctgctcttgtttacagtgctggtttacactgtttttctaagccatcacagctgatatctcctggtgctatccccaaactgccactcttaactcttgaagtaaataaatgatctttgctggcaggactacgctgaatctccttgggcactctctaatcagatatcctgagtcatcccaattcttagaccttttatacctgtttttctccttctgttattccatttagtttctcaattcatccaaaaccgtatccaggccatcaccaatcattctatacgacaaatgtttcttctaacatccccacaatatcaccccttaccacaagacctcccttcagcttaatctctcccactctaggttcccacgccacccctaatcccgcttgaagcagccctgagaaacatcgcccattctctctccataccaccccccaaaaattttcaccgccccaacacttcaacactattttgttttatttttcttattaatataagaaggcaggaatgtcaggcctctgagcccaagccaagccatcgcatcccctgtgactttcacatatatgcccagatggcctgaagtaactgaagaatcacaaaagaagtgaatatgccctgccccaccttaactgatgacattccaccacaaaagaagggtaaatggccagtccttgccttaagtgatgacacttggtattaccttgtgaaagtccttttcctagctcatcctggctcaaaaagcacccccactgagcaccttgccacacccactcctgcccgccagagaacaaaccccctttgactgtaattttcctttacctccccaaatcctataaaacggccccacccctatttcccttccctgactctcttttcggactcagcccgcctgcacccaggtgaaataaacagccatgttactcacacaaagcctgtttggtggtctcttcacacagacgcgcatgaaa

SEQ ID NO: 726 - DNA, 716 bp, Homo sapiens
gtcaggcctctgagcccaagcttagccattatatcccctgtgacctgcacatatacatctagatggcctgaagcaactgaagaaccacaaaagatgacattccaccattgtgatctgttcctgccccaccctaactgatcaattgaccgtatgacaatacaccctccccgcccttgcgataacgtactttgtaatattctccctgcccttgagaatgtacgttgtgagatccaccccctgcccacaaaaaaattgctcctaactccaccgcttatcccaaacgtataagaactaatgataggctgggtgccgtggctcacgcctataatcccagcactttgggaggccgaggcaggaggatcacaagatcaggagttcgagaccagcctggccaatatggtgaaaccccttctctactaaaaatacaaaaattagctgggcgtggtggcaggtgcctgtagttccagctacttgggaggctgaggcaggagaatcgcttgaacctgggaggcagaggttgcagtgagctgagattgcgccattgcactgtagcctgggcgacaaagtgagactccgtctcaaaaaaaaaaaaaagaaaaaactaatgataattccataccctttgctgactctcttttcagactcagcccgcctgcacccagctttattgctcacacaaagcctgtttggtagtctcttcacactgacgcgtgtga

SEQ ID NO: 727 - DNA, 962 bp, Homo sapiens
gtggggaaaagaaagagaagtcagactgttactgtgtctatgtagaaagaagtagacataagagactccattttgctctgtactaagaaaaattcttctgccttgagatgctgtttatctgtaaccctacccccaaccctgtgctccccgaaacaagtgctgtgtcgactcaacgtttaatggatttagggctatgcaggatgtgctttgttaaacaaatgcttgaaggcagcgtgctgttaaaagtcatcaccactccctaatctcaagtacccagggaaataaaacaccacggaaggcggcagggacctctgcctaggaaagccaggtattgtccgaggtttctccccatgtgatagtctgaaatgtggccttgtgggaagggaaagacctgatcgtcccccagcctgacacccataaatggtctgtgctgaggaggattagtaaaagaggaaggcctctttgcagttgagataagaggaaggcatctgtctcctgctcatccctgtcatccctgagcaatggaatgtctcggtgtaaaaccctatggtatattccatctactgagacaggagaaaaccaccttaggactggagttgagacatgctggtggcaatactgctctttaatgcattgagatgtttatgtatatgcacatcaaagcacagcacctttttctttaccttgtttatgatacagagacatttgttcacatgttttcctgctgaccctctccccactgttaccctattgtcctgccacatccccctctcagagatggtagagataataatcaataaatactgagggaactcagagaccatatgctgagcgcggatcccctgggcccacttttctttctctatactttgtctctgtatctctttcttttctcagtctctcgtacccccgccccccgacgagaaacgcccacaggtgtggaggggaagacctccccttca

SEQ ID NO: 728 - DNA, 790 bp, Homo sapiens
gagagacaggactagctggatttcctaggccgactaagaatccctaagcctagctgggaaggtgaccgcttccacctttaaacacggggcttgcaatttatctcacatctgaccaatcagatagtaaagagagctcactaaaatgctaattaggcaaaagcaggaggtaaagaaatagccaatcatctatttcctgagagcacagtgggagggacaaggatcagcatataaacccaggcatttgagccagcaagggcaaccccctttgggttgcctccctttgtatgggagctctgttttcactctattaaatcttgcaactgcactcttctggtctgtgtttgttatggctcaagctgggctttcacttgccatctgtccaccactgctgctggctgccgtcgcagacccgccactgacttccatccctccagatccaacagggtgtccgctgtgctcctgatccagtgaggcgcccattgctgctcccgatcgggctaaaggcttgccattgttcctgcactgctaagtgcctgggtttgtcctaatcaagctgaacactagtcactgggttccatggttctcttccgtgacccacgccttctaatagagctgtaacactcaccacatggtccaaaattccattccttggaatccgtgaggccaagaaccccaggtcagagaacacgaggcttgccaccatcttggaagtggcctgctgccatcttggaagcagccaccaccatattgggagctctgggagcaaggacccctccaccccagtaacact

SEQ ID NO: 729 - DNA, 360 bp, Homo sapiens
gtcaggcctctgagcccaagcctgcacatatacatccacatggcctgaagtaactgaagaatcacaaaagaagtgcaaatggctggttcctgccttaactgatgacattaccttgtgaaatcccttctcctggctcagaagctcccccgctgagcaccttatgacccccgccccggcctgccagagaacaaccccctttgactgtaattttccactacccacccaaatcctataagatggccccacccctctctcacttccctgactcttttcagactcagcccgcctgcacccaggtgattaaaaagctttattgctcacacagagcctgtttggtggtctccacacggacgcgcgtga

SEQ ID NO: 730 - DNA, 977 bp, Homo sapiens
gtggggaagagaaagagagatcagtgtctctttctatacggactgtgtctatatagaaagaagtagacatgagagactccattttgttctgtactaagaaaaattcttctgccttgagatgctgttaatctgtaaccctaccccaaccctgtgctcgcagaaacatgccctgtgtcgactcaaggtttaatggatttagggctatgcaggatgtgctttgttaaacaaatgcttgaaggcagctagcttgttaaaagtcatcaccactccctaatctcaagtacccagggacacaaaacactgcggaaggaaggccgcagggacctctgcctaggaaagccaggtttctccccatgtgatagtctgaaatatggcctcatgggaagtgaaagacctgaccgtcccccagcccgacacccgtaaagggtctgtgctgaggaggattagtaaaagaggaaggcctctttgcagttgagataagaggaaggcatctgtctcctgctcatccctgggcaatggaatgtctcggtgtaaaacccgattgtatattccatctactgagataggagaaaaccgccttagggctggaggtgagacatgctggcggtaacactgctctttaatgcaccgagatgtttatgtatgtgcacatcaaagcacagcaccttttccttaaccttgtttatgacacagagacatttgttcacattttcctgctggccctctccccactattaccctattgtcctgccacatccccctctgggagatggtagagatggtagagataatgatcaataaatactgagggaactcggagactggggccagcgtgggtcctctgtatgctgagcgccagtcccctgggcccatttttctttctctatactttgtctctgtgtctctttcttttctcagtctctcatcccaccccacgagaaacacccacagttgtggaggggcaggccaccccttca

SEQ ID NO: 731 - DNA, 686 bp, Homo sapiens
gtcagacctctgagcccaagctaagccatcatatcccctgtgacctgcacgtatacatccagatggcctgttcttgccttaactgatgacattccaccacaaaagaagtgaaaatggcctgttcctgccttaactgatgacattaaccttgtgaaattccttcgactggctcatcttggctcaaaaactcccccactgagcaccttgtgaccccccacccctgccagacagagaacaaccccctttgactgtaattttcctttacctaccgaaatcctataaaagggccccacccctatctcccttcactgactccttttttggactcagcctgcctgcactcaggtgaaataaacagtcttgttgctcacacaaagcctgtttggtggtctcttcacatggacttcagtgaaatttggtgccgtgactcggatcgggggacctcccttgggagatcaatctcctgtcctcctgctctttgctccatgagaaagatccacctacgatctctggtcctcagatcaaccagaccaaggaacatctcaccaattttaaatcgggtaagcggcctctttttactctcttctccaacctctctccctatccctccacctctttctcctttcaatcttggtgccacacttcaatctctcccttctcttaatttcagttcctttccttttctg

SEQ ID NO: 732 - DNA, 44 bp, Homo sapiens
gatggaaggctttccccttccaacggccaccaccaggaatgtca

SEQ ID NO: 733 - DNA, 146 bp, Homo sapiens
tccccaccaagcaccttgtgaccccgtcctgcccgccagagaacaaccccttgactataattttccactacctacacaaatcctataaaactgccccacccctatctccctttgctgactctcttttcagactcagccagtcagca

SEQ ID NO: 734 - DNA, 138 bp, Homo sapiens
ctgaaatatgtccaaaatgtaaaagaggaaaacactggactaatcagtgtcactctaaatttgataaagatgggaacccgatttcaggaaacaccatgaggggtccctcctgggccccgttctaaaccggggcattcc

SEQ ID NO: 735 - DNA, 7257 bp, Homo sapiens
gtcaggtctctgagcccaagctaagccatcataacccctgtgacctgcacgtatacatccagagggcctggagcaactgaagaaccacaaaagatgacattccaccattgtgatttgttcctgccccaccccaactaatcaatcgatcttgtgacattcctcccctggaaaatgagtctcatgatctccccatcctgcaccttatgactcctgtggctgcctgcaagagataaccaccttcaactgtaattttccactatctacccaaatcctataaaaagtgccccaccccatctccctttgctgactccttttttgtactcagcccacctgcacctaggtgattaaaaagctttattacttgcacaaagcctgtctggtggtctcttcacacggactcatgtgacatttggtgctggagacccaggacagggagactccttcaggagactggtcccctgtcctcgcctctctttgtgaggagatccacctacaatgtcaggtcctcagactagcctaaggaacatctctccaattttaaattgggtaagcagccttttttattctcttctccaacctttctcactatccttccacccttcaatctctcccttccttaattttggttcctttccctttctggtagagacagaggagacgcgttttatctgtgaactcaaaactccggtgctggtcatggactcgggaagccagtcttcccttggtgtctaatcactgcagggatgcctgcctgattattcacccacattccaggtgtgtctgatcaccgcagggacccctgccttgatccttcacctttgtggcaagtactacctcccctgggtggcaagtaccacctccccttggtggcaagtaccacctcctgtgggtggcaagtaccacctccctccctccgtgtctctaccctatcttttctctaaacttacctttttactatgggcaaccttccgccctccattcctccatcttctcccttagcctgtgttccaaaaaacttaaaacctcttcaactctcacctgacctaaaacctaagcctcttattatcttctgcaataccacttggccccaatacaaactcggcagtggctctaaatggccagaaaatgacactttcaattcctccatcctacaagatctagataatttttgtcgtaaaatgggcaaatggcctgaggtgcctgatgtccaggcattcttttacacattggtccctccctagtatctgctcccaatgtgactcatcccaaatctttcttcattctcctttctctcctgtctgtcccttcagtctccaccccaagctctgagtcctttgaatcctccttttctacagacctatctgacctctcccctcctcctcaggctgctcctcgccaggccgagccaagtcccaattcttcctcagcctccactcccccaccctataatccttctatcacctcccatcctcacacccagtccagcttacagttttgctccgcgactagccctcccaacaatctcctcttggagaggtggctggagctgaaggcatagtcaaggttaaggctccttttctttatccaccctgtcccagatcagttagtgtttgggctagttttcatcaaatataaaaacccagcccagttcatggcccatttggcaacaacccttagacgctttactgccctagccccagaggggccagaaggctgtcttattctcaatatgcattttattaccaatctgctcctgacattagaaaaagctccaaaaattagattccagccctcaaaccccacaacaggatttaattaacctcgccttcaaggtgtacaataatagagaagaggcagtcaagcaacaacgtatttctgagttgcaattacttgcctccgctgtgagagaaaccccagccacatctccagcacacaagaacttcaaaatgcctaaactgcagcagccaggcattcctccaggacctcctccctcaggatcttgcttcaagtgctggaaatctggccactgggccaagaaatgcccgcagcccaggattcctcctaagccatgtcccatctttgtgggaccccactggaaatcggactattcaacttgcccagcagccactcccagagcccctggaactctggcccaaggctcttggactgactcctttccagatcttctcaccttagcgggtgaagactgacactgcccaattgcattggaaacctcctggaccatcacagatgctttgggtaacttttacagtggagggtaagtctctccccttcttaatcaatatggaggctacccactccacattaccttcttttcaagggcctgtttcccttgcctccataactgttgcaggtattgacggccaggctgctagaccccttaaaactccctcactctggtgccaacttggacaacattcttttatgcactttttcagttttccccacctgcccagttcccttattaggttgagacattttaactaaattatctgcttccatgactattcctggactacagccacatctcatcgctgcccttctccccaacccaaagcctcctttgtgtcttcctctcatatcccccaaccttaatccacaagtctgggacacctctactccctccctggcaaccgatcacatgcctattactatcccattaaaacctaatcacccttacccgctcaacaccagtatcccatcccacataggctttaaggggactaaagcctgttatcatctgcatgttacaacatggcctcttaaagcctacaaattctctttataactcccctatcctacccatccagaaaccagacaagtcttacaggttggttcaggatctttgccttattaatcaaatcgtccttcccatccatcctatagtgccaaacctgtacaccctcctatcttcaatacctccttccgcaattcactattccattcttgatcttaaagatgcttttttcactattcccctgcacccctcgtcccatcctctctttgcttttacctggactgaccctgatatccatcagtcccagtagcttacctgggctatactgccacaaggcttcagggaccgtcctcattagttcagccaagctctttctcatgatttactttctttccacccctctgcttctcaccttattcaatatattgatgaccttctactttgtagcccctcctttgaatcttctcaacaagacaccctcctgttccttcaacatttattctccaagggatatcgtgtatccccctccaaagctcaaatttcttcctcatctgttacctaccttggcataattcttcatgaaaacacaagtgcacttcctgccaattgtgtccagctgatctctaaaccccaaccccttctacaaaacaacaactcctttccttcctgggcatggttggatactttcacatttggatacctggttttgccatcctaacaaaaccattatataaactcacaatgggaaacctagctgacaccatagatcctaaatcctttccccactcctctttctgttccttaaaaacagctctggagactcctcccacactagctctccctgactcatcccaacctttttcattacacacaaccaaagtgcagggctgtgcagtcggaattcttacacaaggatcgggaccacgccctgtagcctttttgtccaaacaacttgaccttactgttttaggctggctctcatgtctgcatgcagcagctgctgctgctctaatacttttagaggccctcaaaatcacaaactatgctcaactcactctctacagttctcataactttcaaaaactattttcttcctcacatgtgacgcatatactttctgccccccagctccttcagctatactcactctttgttgagtctcctacaattaccattgttcctggcccggacttcaatccagcctcccacattattcctgataccacacctgatccctatgactgtatctctctgatccacctgacattcactccattacccatatttccttctttcctgttcctcaccctgatcacacttggtttattgatggcagtaccaccaggcctaatcacaattcaccagcaaaggcaggctatgctatagtatcttccacatctatcattgaggctaccactctgccccactccactacctctcagcaaaccaaactcctagacttaactgaagccctcactcttgcaaaatgactgcatgtcaatatttatactgactttatatatgccttccatatcctgcaccaccatgctgttatatgggctgaaagaggttttctcactacgcaagggtcctccatcattaatgcctctttaacgaaaactcttcacaagcctgctttacttccaaaggaagctggagtccttcactgcaaaggccatcaaatggcctcagaccccattgctcaaggcaacaattatgctgataagacagcaaaagaagcagccagtattcctacttctttcactcacggccggtttttctctttctcatcagtcattcctacttactctcccactgaagtttccacctatcaatccctccccactcaaggcaaatggttcttggaccaaggaaaatatctccgtccagcctcagaggcccattctattctgtcatcctttcataacctcttccatgtaggttacaagccactagcccatctctcagaacctctcatttcctttccatcatggaaatctatcctcgaggaaatcacttctcagtgttccatctgctattctactactcctcagggattgttcaggccccctcctttccctacacatcaagctcaggggtttgcccctgcccaggactgggaaattgactttactcctgggaaactccaggaaacttggagtttcctgctccaagtcaggaaactaaaatacctcttggtctgggtagatactttcactggataggtagaggtctttcctacagcatctgagaagaccaccattgtcattttttcccttctatcagacataattcctcagtttggccttcccacctctatacagttcaataatggactggcctttattagtcaaatcacccaagcaatttctcaggctcttggtattcagtggaaccttcataccccttagcatcctcaatcttcaggaaaggtagaacagactaatggtcttttaaagacacacctcaccaagctcagtgaccaacttaaaaaggactggacagtacttttacctcttgcccttctcagaattagtctgtcctcgagatgctacagggtacagtccacttgaacttttatatggacgcactttcttgctcagccccaacctcgtcccagacaccagctctctagatgactatcttccagtcctccagcagatgagacaggaaattcaccaggctgctagtcttctcttgcctactccagattctcagccatatgaagacaccctagctgaacgatcagttcttgttaagaatctgacccctcaaactctacaacctcaatggaccggaccctgcttagtcatctatataccccaactgcaggcctgcaggaccctctccattcctgttctagtgattgcccccctccatatcactgttccagaataaagctgtatctgtcagccagccagcctgatctctcctcttcctcctggaagtcgcaagtactcacccctacttcccttgaactcagtttcatttctgaagaacagtaataacacttatgagcctaatacatctcttcattctattacgtctattcatccttaccctactttttgcaacagggctttacatagtcacccccactacttggaccgcaccctaaaaacttgtcatccctactatcttctgtctagtcatactcctattcaccattcccaactactcataaatgccctgcccttgtttacactgccagtttacactttttctctaaaccatcataactgatatctcctagttttacctcaaactgccattcttgactccctcttggagtgggtaggtgatctttgctgacagggcaccctccaatactttcaccctgatgaagtcctattctttacttgtatactcactcttattctcgttcccgttcttatgccaccctctacctctccccagctatctccaccacactatcaatctcactcactctctcctagctgtttctaatccttctttaacaaacaattgctggctttgcatttctctttcctccaaaaccactgaggcctcaacttactcactgctaaaaaaaaaaaaaagaggactctgtatatttttaaatgaagaatgttgtttttacctaaatcaatctggcctggtatagaaaaacataaaaaaaaaaaaaaacaaactcaaggatagagccccaaaactcgccaaccaagcaaataattatgctgaacacccttggatactctctaattggttgttctgggtcctcccaattcttagtcctataatacctgtttttctccttcttttattcagaccttgtatcttccatttagtttctcaattcatacaaaactgcatccaggccatcaccaatcattctatatgacaaatgctccttctaacaaccccacaatatcaccccttaccgcaaagtctttcttcagtttaatctctcccactcaagttcccacattgcccctaatcctacttgaagcagccctgagaaacatcacccattatctctccataccacccccaaaattttttgctgccccagcacttcaccactattttgttttgtttttcttactaatataagaagacaggaatgtcaggcctctcagcccaagctaagccatcataacccctctgacctgcatgtatacatccagagggcctggagcaactgaagaaccacaaaagatgatattccaccattgtgatttgttcctgccccactccaactaatcaatcgaccttgtaacattcctcccctggacaatgagtctcatgatccccccatcctgcaccttgtgaccaccgcccctgcctgccctgcaagagataaccacgtttaactgtaattttccactacctacccaaatcctataaaactgcctcacctctatctccctttgctgactctctttatggactcagcccacttgcacccaagtgaaataaacagccttgctgctcacacaaagcctgttggtggactctcttcacatgtacttgcgtga

SEQ ID NO: 736 - DNA, 963 bp, Homo sapiens
gtggggaaaagcaagagagatcagattgtcactgtgtctgtgtagaaagaagtagacatgggagactccattttgttatgtactaagaaaaactcttctgccttgagattccgtgaccttacccccaaccccgtgctctctgaaacatgtgctgtgtcaaactcagggttaaatggattaagggcggtgcaagatatgctttgttaaacagatgcttgaaggcagcacgctccttaagagtcatcaccactccctaatctcaagtacccagggacacaaaaactgcggaaggccacagggacctctgcctaggaaagccaggtattgtccaaggtttctccccatatgatagtctgaaatatggcgtcgtgggaagggaaagacctgaccgtcccccagcccgacacccgtaaagggtctgtgctgaggaggattagtataagaggaaggcatgcctcttgcagttgagacaagaggaaggcatctgtctcctgcccgtccctgggcaatggaatgtctcagtataaaacccgattgtacattccatctactgagatagggaaaaaccgccttagggctggaggtgggacatgccggcagcgatactgctttgtaaagcattgagatgtttatgtgtatgcatatctaaaagcacagcacttaatcctttaccttgtctatgatgcaaagacctttgttcacatgtttgtctgctgacccactccccactatagtcttgagaccctgacacatccccctctcggagaaacacccacgaatgatcaataaatactaagggaactcagaggctggagggatcctccatatgctgaacgctggttccccgggtccccttatttctttctctatactttgtctctgtgtctttttcttttccaagtctctcgttccaccttgcgagaaacacccacaggtgtggggggggggtaacccaccccttca

SEQ ID NO: 737 - DNA, 662 bp, Homo sapiens
ttacagtaggtaactagtcagacatgagcagggcaggagaaagctcccactactcccacacacaccaaaaatgttacaccactatcacgtgatgatcaggaagttgttagctgtctctctaaaataataattgatcacagctggtgccagggaaaggcagactcccaatagatagaaacactgaatctggtgatcagcagcttcccaacaagatctcaggagttgggtgagtgggctgaagcatgtgcattaagaggcaaatggtagagtttaactggtatatgactttctaggatccttctatcggaaagagaagaacaccttaagtgagcatgcatccaactccaataaacacactgcacatgctcatttcccaagtgctagcaggtcactgcacatgtggacagcccaacccaagagaagaatcagtggagaagggacacaagaccccagaagaatgccaacgtacaaaactccaagtcaaaaggtcaaaccacacacctgatctccgaagttgcccagttggcctgcttcttacttcctttcattcctgctttaaaacttgcctcggtctctccttctgccttatgcccctcagtcaaattctttcttctgaggaggtgaaaattgaggctgctgctggcccatatggatttgccagt

SEQ ID NO: 738 - DNA, 988 bp, Homo sapiens
gtgggggaaagaaagagagatcagactgttactgtgtctatgtagaaaaagacaggcataagaaacttcattttgatctgtactaagaaaaatttttctgccttgagatgctgttaatctgtaaacctagccccaaccctgtgctcgcagaaacatgtgttgtattgactcaaggtttaatggatttagggctgtgcaggatgtgctttgttaaaattgtgtttgcaggcagtatgcttggtaaaagtcatcgccattctccattctcaagtacccagggacacaatgcactgcggaaggccacagggacctctgcccaagaaagcctgggtattgtccaaggtttccccctactgagacagcctgagatatggcctcatgggaagggaaagacctgatcatcccccagcctgacacccgtaaagggtctgtgctgaggaggattagtgaaagaggaaggcctctttgcagttgagataagaggaaggcatctgtctcctgctcatccctgggaatgaaatgtctcggtgtaaaacccaattgtacattctatttactgagataggagaaaaccaccttatgactggaggtgagacatgctggcagaaatactgctctttactgcattgagatgtttgtgtaaagtcaaacataaatctggcctacatgcacatcaagtcacagcacctttccttaaacttatttatgacaaagagtcctttgctcacatgttttcctgctaaccctctccccaccatgaccctatagttctgccacatcccccttgccagaatagtagagataatgatcaataaatactgagggaactcagagaccagtgccagtgcaggtcctcacttgctgagcgccggtcccctgggcccacttttcttcctctatactttgtctctgtcttatttcttttctcagtctctcatctccaccttgcaagaaatacccacaggtgtggaggggcaggcccccttca

SEQ ID NO: 739 - DNA, 706 bp, Homo sapiens
tatagtaggtagttaggcatgagcagggcaggagaggtctcccctgccctaccaggaatgtcaggcaacaatcaggtgatggtcaggcggttgttaactgtctctctaaaataataattggttgcagccagcaccagggaaaggcagtctcccagtagacagaaaacacctgaaggtggtgatcagcagcttcccaataagacctcaggagttgggcgagtgggctcaagcatgtgcactaagaggcaaaatggtggagtttaactggtatatgacctccttgggacatttgactggtaagggaagaacgcctcaagttagcgtgtatataactccagtaagcacactgcacatgctcccctcccaaatgctagtcaggccactgcacatacggacagcctgccccaaaatcaaggagaaggaatgcaagaccctgggagcatgccaacatataaaaccccaagtcaaaaggtcaaactgcacatttgatctctcaagtcacccccttggccctcttccaagtgtactttacttcctttcactcctgctctaaagattttaaacaaactttctcctgctctaaaacttgtctcagtctgttactctgccttatgcccctcagtcgagttctttcttctgaggaggcaagaattgaggttgctgcagacccatatggatttgctgccactaacatagtttggtgcca

SEQ ID NO: 740 - DNA, 752 bp, Homo sapiens
gagagacagaactagctggatttcctaggctgactaagaattcttaagcctagctggggaaggtgaccgcaccacacctacctttaaacacagggcttgtaactcagctcgcactccaccaatcaggtaggaaagagggctcactaaaatactaattaggctaaaagcaggaggtaaagaaatagtcaaatcatatatcgcctgagagcacagggggaggggcaatgattaggatataaacccaggcattctagcagggaggggcaacccccattgtatgggagttctgttttcactctattaaatcttgcaactgcagactcttctggtctgtgtttgttatggctcgagctgagcttttgctcactgtccaccactgctgtttgccgctgtcgcacacccgccggtgacttcctcccatccggatccagcaggatgtccgctgagctcctgatccagtgaggtgcccattgccactccagatcaggctaaaggcttgccattgttcctgcacggctaagtgcccaggtttgtcctaattgagctgaacactagtcgctgggttccactgttctcttccatgacccatggcttctaatagggctataacactcaccgcatggcccaaggttccattcctcggaatccgtgaggccaagaaccccaggtcagagaacaaaaggcttgccactatcttgggagtggcccgccaccatcttgcgagctctaaggacaaagaaccgccagtaaca

SEQ ID NO: 741 - DNA, 6158 bp, Homo sapiens
gtcaggcctctgagcccaagctaagccatcgtatccccagtgacctgcacatatacatccagatggcctgtttggtgttctcttcacatagacatgtgagacatttgatgccaaaacccaggacgggaggactccttcgggagaccggtcccctgtcctcgccctcactccgtgaggagatccacctatgacctcgggtcctcagaccaaccagaccaaggaacatctcaccaatttcaaatcaggtaagcagtcttttcactcttctctggcctctctcgctacccttcaatctccctgtcattccaattccagttctttttcctctctaatagagacaaaagagacacattttattcgtggacccaaaactccggcgctagtcatggacttgggaagacagccttcccttgatgtttaatcactgcggggacacctgcctgattattcacccacatttcattggtgtctgatcaccgcagggatgcctgccttggtcattcacccacattcccttggtggcaagtcaattgcggagacgcctgctttggctgctcacccacattgcagcccagggctgctctccacccccttctctgtgtctccacctttctctttaaactaacgtccttcactatgggcaaccttccgccctccattcccccttcttctcccttagcctgtgttctcaagaacttaaaacctcttcaactcgcacctgacctaaaacttaaatgccttattttcttctgcaatactgcttggccccaatacaaactcgacagtagttccaagtggccagagaatggcactttcgatctgtctatcctataagatctagatagtttttgtcgaaaaatgggcaaattcctacaagatctagataatttttgttgaaaaatgggaaatggtctgaggtgcctgacatccaggcattcttttacacattgctccctccctagtctctgctcccaatgcgacttgtcccaaatctttcttctttctcctgtctgttccctcagtcaccaccccaagctctgagtcctttgaatccttcttttctacagactcatctgacctctccccttctccccaggctgctcctcgccaggccaagccaggtcccaattcttcctcagccgctgctccccaaccctaggatctatctgtcacctcccctcctcacacccagtctggcttacagattcgttctgcaactagccctcccctacctgcccaacaatttcctcttaaaaaggtggctggagctaaaggcaagtcaaggtttctttatctgaccactcccaaatcagttagcatttaggttttttttcatcaaatataaaaacccagcccagttcatggcatgcttggcaacaacccttagacactttactgtcctagatccaggaggaaggctgtcttattctcaatatgcactttattacccagtccactcctgacattggaaaaagctccaaaaattagattccggccctcaaaccccataacaggaccttattaacctcgctttcaaggtgtacaataatagagtagatgcagccaagtagcaacgtatttctgagttgcaattacttgcctccactgtgagagaaaccccagccacatctctagcacacaagaacttcaaaacgtctgaaccgcagcggccaggcgttcctccaggaccgcctcccccaggatcttgctctaagtgctggaaatctggccactgggccaaggaatgcccgcagcccaggattcctcctaagccgtgtcccatctgtgtgggaccccattggaaattggactgtccaactcgcccggcagccactcccagagcccctggaactctggcccaaggctcgctgactgattccttcccagatcttctcagcttagtggctgaagactgatgctgcctgatcacctcagaagcctcccggaccatcacggacgctttgggtaactcttacagtggagggtaagtctgtccccttcttaatcaatacggaggctacccactccacattaccctcttttcaagggccagtttcccttgcctccataaccgttgtaggtattgacagccaggctgctaaacctcttaaaactccccaactctggtgccaacttggacaacattctttaatgtactccttttatttatccccacctgcccagctcttattaggatgagacattttaactaaattatctgcttctctgactattcctgggctacagccacacctcattgccgccttttcccccagttcaaagcctccctcacatcctttccttgtatctccccaccttaatccacaagtataggacacctctactcccgccttggcaacggatcatgcaccccttaccatcccattaaaacctaatcacccttaccccgctcaatgccaatatcccatctcacagcacgctttaaaaggattaaagcctgttatcacttgcctgttacagcatggccttttaaagcctataaactctccttacaattcccccattttagctgtccaaaaactggacaagtcttacaggttagttcaggatctgagccttatcaaccaaattatcttccctatccaccccgtggtgccaaacccatatactctcctatcctcaatacctccctccacaacccattctgttctagataaacctagctgaccccataaatcctaactcctttccccactcccctttccattccttaagaagcagccctaaaagctgttcccacactagctctccctaactcatccccacccttttcattacacacagccaaagtacagggctgtgcggtcagaattcttttttttttttttgagaagagtctcgccgtgtcacccaggctggagtgcagtggcacgatagtcagtattcttacacaagagccaggagtgcgccctgtagcctttctgtccaaacaacttgaccttactgttttcgcatagccctcatgtctgcatgtggcggctgctgctgctgctttaatacttttagaggccctcaaaatcacaaactatgctccacttactctctacagttctcataactttcaaaatctattttcctcctcacacttgaagtatatactttctgccccccagctccttcaggtatactcagtctttgttgagtctcccacacttaccattgttcctggcctggacttcaatccagcctcccacattattccagataccacacctgacccccatgactgtatctctctgatccacccgacattcacttcatttccccatatttctttctttcctgttccttaccctgatcacacttggtttattgatggcagctccaccaggcctaatcaccactcaccagcaaaggcaggctatgctatagtatcttccacatctatcattgaggctaccactctgcccccctccactacttctcagcaggctgaactcattgccttaactcgggccctctctcttgcaaagggactacacgtcaatatttatactgactctaaatatgccttccatatcctgcaccaccatgctgttatatgggcagaaagaatgtcctcactatgcaagggtcctccatcattaatgcctctctaataaaaacttctcaaagctgctttacttccaaaggaagctggagtcattcactgcaagggccatcaaaaggcatcagatcccatcactcagggcaacacttatgctgataaggtagttaaagaagcagctagcgtttcaacttctgtccctcatggcccgtttttctccttctcattggtcactcctatttactcttctactgaagtttccacctatcaatctcttcccacacaaggcaaatggttcttggatcaaggaaaatatctccttccagcctcacaggcccattctattctgtcatcatttcataacttcttccatgtaggttacaagctgttagcccacctcttaaaacttctcatttcctttccatcgtgaatatctatccccaatcctccactcttgactccctcttggagtggatagatgatctttgctgacaggacacactccaacactttcaccctgatgaagtcctattctttacttttatactcactcttgttctcattcccattcttatgccaccctctacctctccccagctatctccaccacactatcaatctcactcactctctcctagccatctctaatccttctttaagaaacaattgctggctttcaaaagaacaaagctggaggcatcatgctacctgacttcaaactatactacaaggctacagtaaccaaaacagcatggtactggtaccaaaaaagagatatagaccaatagaacagaacagagccctcagaaataatatcacacatctacaaccatctgatctttgacaaacctaacaataacaagaaatggggaaaggattccctatttaataaatagttctgggaaaactggctagccatatgtagaaagctgaaactggatcccttccttacaccttctacaaaaattaattcaagatggattaaagacttaactgttagacctaaaaccataaaaaccctagaagaaaacctaggcaataccattcaggacataggcatgggcaaggacttcatgtctaaaacaccaaaagcaatggcaacagaagccaaaattgacaaaagggatctaattaaactaaagagcttctgcacagcaaaagaaactaccatcagagtgaacaggcaacctacagaatgggagaaaatttttgaaatctacttatctgacaaaaggctaatatccggaatctacaaagaactcaaacaaatttacaagaaaaaaacaaacaaccccatcaaaaagtgggcaaaggatatgaacagacacttctcaaaagaagacatttaagaagccaacagacacatgaaaaaatgctcatcatcactggccatcagagaaatgcaaatcaaaaccacaataagataccatctcacaccagttagaatggccatcattaaaaagtcaggaaacaacaggcgctggagaggatgtggagaaataggaacacttttacactgttggtgggactgtaaactggttcaaccattgtggaagacagtgtggcaattcctcagggatctagaactagaaataccatttgacccagccatcccattactgggtatatacccaaaggattataaatcatgctgctataaagacacatgcacacgtatgtttatcgtggcactattcacgatagcaaagacttagaaccaacccaaatgtctatcaatgatagactggattaagaaaatgtggcacatatacaccatggaatactatgcagccacaaaaaaggatgagttcatgtcctttgtagcaacatggatgacgctggaaaccagcattctcagcaaactatctgagcaaacaaacaaggacaaaaaaccaaacaccgcatgttctcactcataggtgggaattgaacaatgagaacacttggacacagaaaggggaacatcacacaccggggcctcttgtgcggtgcggggacgggggagggatagcattaggagatacacctaatgtaaatgatgagttaatgggtgcagcataccaacatggcacatgtatacatatgtaacaaacctgcacattgtgcacatgtaccctataacttaaagtataatttaaaaaaataagtaaataaataaataaaaaagaaacaattgctggctttgcaattctctttcctccaaaatcgccgaggcctcaatttactcattgctgaaaaaggaggactctgtatatttttaaatgcagagtgttgtttttacctaaatcaatctggcctggtatatgacaacataaaaaaactcaaggatagagcccaaaaacttgccaaccaagcaaataactatgctgaacccccttgggcactctcttaattggatgtcctgggtcctcccaattcttagtcctttaatacctgtttttctctttctcttattcagaccttgcgtcttctgtttagtttctcaattcatacaaaaccatatccaggccatcaccaataattctatatgacaaatgctccttctaacaaccccacaatatcagcccttaccccaaaatcttcagctgaa

SEQ ID NO: 742 - DNA, 468 bp, Homo sapiens
gtaggagatcggtcaggatggtgggaaaagttgtaagataaattataggaaaaggatgcaaaccttcttggaaggcctgggatttgcatagcttcagaagaggatttggctgaaggcagctgaattttctcagaatggataacaaggaagtgtaaaggaattgatctagataagttagtttacttaggcctcggaacctggtatttaatcatctgtgcacaggactgctgtcttggggggtggggggtgacaatgttaattacccacaagacgtgttgactccaggcctttgtcattaaatctgtactgaataaatgcccacagtgccagcttgtcggggctgtggctactgactctttacagctccctcctcggtgtctgtgagctgcccagtcccctagcctgctttttcactggatatcagtctcagagtgcatttttcatctgtcattcggccaggttggaccc

SEQ ID NO: 743 - DNA, 5621 bp, Homo sapiens
gtcaggcctctgagcccaagctaagccatcatatcccctgtgacctgcacgtacacatccagatggccagttcctgccttaactgatgacattccaccacaaaagaagtgaaaatggcctgttcctgccttaactgatgacattatcttgtgaaattccttctcctggctcatcctggctcaaaagctcccctactgagcaccttgtgacccccactcctgcctgccagagaacaacctccctttttcctttacctacccaaatcctataaaatggccccacccctatctcccttcactgactcagcctgcctgaacccaggtgaaataaacagctttattgctcacacaaagcctgtttggtggtctcttcacatggacgcaagtgaaatttggtgctgtaactcggatcgggggacctcccttaggagatcaatcccctgtcctgctctttgctccgtgagaaagatccacctacgttcaggtcctcagaccgacgaccccaagaaacatctcaacaatttcaaatccggtaagcagcctgtttttagtctcttctccaacctccctcactatccctcaacctctttctcctttcaatcttggtgccacacttcaatctctcccttctcttcatttcaattcttttcattttctggtagagacaaaggagacacgttttatccgtggacccaaaactcctgcaccggtcacagactagggaaggcagccttcccttggtgtttaatcattgcagggacgcctttctgattgttcacccaggtttcagaggtgtcagaccacacagggacacctgccttggtccttcacccttaatggtaagtcctgcttttctgggggaaaggcaagaaacctaaccccttctctccatgtctctaccccttctctgcttttctgggggaggagcaagaacccctcaaccccttctccttcacccttagcggcaagtcctgcttttctgggggagggacaggaactctgacctcttatctctgtgccccgatcccttatttccaccccccaacctcttatctctgtgccccgatccctgatttctgtgccccgacctcttatctctgcaccccaaccccttatttccgtgcctcgaccccttctctgcttttctggagggcaagaaccccccaccccttctccgtgtctctactgtctttcctctgggcttgcctccttcactatgggcaagcttccaccttccattcctccttcttctcccttagcctgtgttcttaagaacttaaaacctcttcaactctcacctgacctaaaatctaagtgtcttattttcttctgcaatgccacttgaccccaatacaaactcgacagtagtttcaaatagctggaaaacggcactttcaatttttccatcctacaagatctaaataattcttgtcgtaaaataggcaaatggtctgagatgcctgacatccaggcattcttttatacatcggtccctctctagtctctgttcccaatgcaacccctcccaaatcttccttctttccctcccacctgtcccctcagtcccaaccccaagcattgctgagtctttctaatcttccttttctacagacccatctgacctctcccctcctcaccaggccaagctaggtcccaattcttcctcagcctccgctcctccactctataatccttttatcacctcttctcacacccagtctggcttacagtttcgttccgtgactagccctcccccacctgcccagcaatttactcttaaaaaggtggctgaagctaaaggcatagtcaaggttaatgctcctttttctttatctcaaatcagatagcatttaggctctttttcatcaaatataaaaatccagcccagttcatggctcatttggcaacaaccctgagacgctttgcagccctagaccctaaaaggtcaaaaggccgtcttattctcaatatacattttattacccaatctgctcccaacattaaataaaactcgaaaaattaaattccagccctgaaaccccacaataggacttaattaacctcaccttcaaggtgtacaataatagagtaaaggcagccaagtagcaacatatttctgagttgcaattccttgcctccactgtgagacaaaccccagccacatctccagcacacaagaacttccgaacgcctaaactgcagtggccaggcattcctccagaaccgcctcccccaggagcttgctacaagtgccagaaatctggccaccatgccaaggaatgcccacagcccaggattcttcctaagccatgtcccatctgtgcgggaccccactggaaataggactgttcaactcacctggcagccactcccagagcccctggaactctggcccaaagctctctgactgactccttcccagatcttctcggcttagcggctgaagactgatgctgcccgatcacctcggaagccccgtagatcatcacagacaccgagctttaggtaactctcacagtggagggtaagtccgtccccttcttaatcagtatggaggctacccactccacattaccttcttttcaagggcctgtttcccttgcttccataactgttgtgcgtattgacagccaggcttctaaacctcttaaaactccccaactctggtgccaacttagacaatactcttttaagcactcctttttaattatccccacctgcccagttcccttattaggccgagacactttaactaaattatctgcttccctgactattcctggactacagctgcatctcattgctgcccttcttcccaatccaaagcctcctttgcgtccttctcttatatcccccaaccttaacccacaagtataagatacctctactccctccttggcgaccaatcatgcaccccttaccatctcattaaaacctaatcacccttatcctgctcaatgccaatatcccatcccacagcatgctttgaaaggattaaagcctcttatcttttgcctgctacagcatggccttttaaagcttataaactctccttacaattcccccattttacctgtcctaaaaccagatgagccttacaagttagttcaggatctgtgccttatcaaccaaattgttttgcctatccaccccatggtgccaaacccatatactctcctatcctcaatacctccctccacaatccattattctgtctggatctcaaacatgctttctttactattcctttgcaccgttcatcccagcctctctttgctttcacttggactgaccctaacacccatcaggctcagcaaattacctgggctgtactgctgcaaaggttcacagacagcccccattacttaagtgaagcccaaatttcttccttatctgttacctatctcagcataattctcataaaaacacacgtgctctccctgccggtcgtgtccgactaatctctcaaaccccaaccccttctacaaaacaactcctttcctttctgggcatggttggatactttcgcctttggatacctggttttgccatcctaacaaaaccattatataaactcacaaaaggaaacctagctgaccccatagatcctaaatcttttccccattcctctttccattccttgaagacagctttggaggctgcccccaccccagctctccctgactcatcccaacccttttcattacacacagctgaagtgcagggctgtgcagtcagaattcttacacaaggaccgggatcgcgtcctttttgtccaaacaacttgaccttactgttttaggctggccatcatgtctctgtgcagcagctgctgccaccctaatacttttagaggcccttaaaatcacaaactatgctcaactcactctctacagctctcataatttccaaaattgattttcttcctcacacctgacacatatactttctgcttcccagctccttcagctgtactcactctttgttgagtctcccacaattaccattgttcctgacccggacttcaatccggcctcccacattattcctgatatcacacctgaccctcatgactgcatctctctgatccacctgacgttcatctcatttccccgcatttccttcttccctgtttctcaccctgatcacgcttggtttattgatggcagttccaccaggcctaatcaccacacaccagcaaaggcagctatgctatagtacaagccactagcctgcctcttagaacctctcatttcctttccatcatggaaatctatcctcaaggaaataaattctcagtgttccatctgctattctactactcctcagggattattcaggccccctcccttccctacacatcaagctcagggatttgcccccgcccaggactggcaaatttgctattctactacttctcaaggattattcaggccccctcccttccctacacatcatgctcagggatttgcccctacccaggactagcaaattagctttactcaacatgccctgagtcaggaaactaaaatatctcttggtctaggtagacactttcactggataggtagaggcctttcccacagggtctaagaaggccaccatggtcatttcttcccttctgtcagacataattcctcggtttggccttcccacctctatacagtccaatagcagaccggcctttattagtcaaatcagccaagcattttttcaggctcttagtattcagtgaaacctttatatcccttacagtcctcagtcttcaggaaagatagaacagactaatggtcttttaaaaacacacctcaccaagctcagccaccaacttaaaaaggactggacaatacttttaccactttcccttctcagaattcaggcctgtctttggaatgctacaaggtacagcccctttaagctcctgtatagacgctcctttttattaggccccagtctcattccagacaccagaccaacttagactgtgccccaaaaaacttgtcatccctactatcttctgtctagtcatactcctattcactgttctcaactactcatgcatgccctgctcttgtttacactgccagttttcactgtttctccaagccatcacagctgatatctcctggtgctatccccaaaccgccactcttaactcttaaagtaaataaataatctttgctggcaggactatgctgaacctccttacgcactctctaatcagatagcccaggtcctcccaattcttagtcctttagtacctgtttttctccttctcttattccatttagtttttcaattcatacaaaactgtatccaggcctcaccaataattctaaatgacaattgtttcttctaacaaccccacaatatcaccccttaccacaaaatcttccttcagcttaatctctcccactctatgttcccacgctgcccctaatcccactcgaagcagccctgagaaacatcgcccattctctctccataccaccccccaaaaattttcacctccccaacactttaccactatttcattttatttttcttattaatataagaagacaggaatgtcaggcctctgagcccaagctaagtcatcatatcccctgtgacctgcactca

SEQ ID NO: 744 - DNA, 6118 bp, Homo sapiens
gtcaggcctctgagcccaagccaagccaccagcatcccctgtgacttgcacgtatatccccagatggcctgatgtaactgaagaatcacaaaagaagtgaacatgccctgccccaccttaactgatgacattccaccacaaaagaagtgtaaatggccggtccttgccttaagtgatgacattaccttgtgaaagtccttttcctagctcatcctggctcaaaaagcacccccactgagcaccttgcgacccccactcctgcccgccagagaacaaaccccctttgactgtaattttcctttacctacctaaatcctataaaacggccccacccttatctcccttcgctgactctcttttcggactcagcctgcctgcacccaggtgaaataaacagccatgttgctcacacaaagcctgtttggtggtctcttcacacggacgcacatgaaatttggtgccatgactcggatcgggggacctcccttgggagatcaatcccctgtactcctgttctttgctccatgagaaagatccacctatgacctcaggtcctcagatcgaccagcccaaggaacatctcaccaattttaaatcaggtaagcggcctcttcttactctcttctcccacctctctcactgtccctcaaccactttctcctttccactcttcaatctctcccttctcttaatttcaattcctttcattttctgggagagacaaaggagacacgttttatccatggacccaaaactccggcgccggtcatggactgggaaggcagccttcccttggtgtttaatcattgcagggacgcctctctgattatacacccacgtttcaagggtgtcagaccatgcagagacgcctgccttggtccttcacccttagcggcaagtcccgcttttctggggaaggggcaagtacctcaaccccttctctccttgtctctaccccttctctgcttttctgggagaggggcaagtacccctcaaccccttctccttcacccttagcggcaagtcccacttttctacagggcaagaacccccaatcccttatttccacgccccaacctcttatctctgtgccccaatcccttatttccaagccccaacctcttatctctgtgccccaatcccttatttccaagccccaacctcttatctctgtgccccaatcccttatttccacaccccaacctcttatctctgcaccccaatcccttatttccatgccccaacctcttatctctgtgccccaatcccttatttccgcaccccaacctcttatctctgcaccccaaccctttcccacttttctggaaggtgagaacccccgaaccccttccctccgtttctctactccctcttttctctaggcttccttccttcactatgggcaaccttccaccctccattcctccttctactcccttggcctgtgttctcaaaaacttaaaacctcttcaactcacacctgacctaaaacctaaatgccttattttcttctgcaatgccgcttgaccccaatacaaacttgacagtagttccaaatagccagaaaatggcactttgaatttttccatcctgcaaaatctaaataattcttgtcataaaataggcaaacggtctgaggtgcccgacgtccaggcatccttttatacatcagtcccttcctagtctctgtgcccagtgcaactcatcccaaatcttccttctttcccacccacctgtcccctcaataccaaccccaagcgtcgctgagtctttctaatcttccttttctacagacccatctgacccctcccttcctccccaggctgctcctcgccaggctgagctaggtcccaattcttcctcagcctctgctcctccatcctttttatcacctcccctcctcacacctggtccggcttacagtttccttccgtgactagccctccccctcctgcccagcaatttactcttaaaaaagtggctagagctaaaggcatagtcaaggttaatgctcctttttctttatcccaaatcagatagcgtttagggtctttttcatcaaatataaaaatccagcccagttcatgacttgtttggcaacaaccctgagacatttcacagccctagaccctaaaaggtcaaaaggccatcttattctcaaaatatattttattacccaatctgctcccgacattaaataaaactccaaaaattaaattccagccctcaaaccccacaacaggatttaattaacctcgccttcaaggtgtacaataatagaaaaaagttgcaattccttgcctccactgtgagacaaaccccagccacatctccagcacacaagaagttccaaaagcctgaactgcagcagccaggcgttcctccagaacctcctcccacaggagcttgctacatgtgccggaaatctggccactgggccaaggaatgcccgcagcccgggattcctcctaagccgcatcccatctgtgtgggaccccactgaaaatcggactgttcaactcatctggcagccactcccagagcccctggaactctggcccaaggctctctgactgactccttcccagatcttcttggcttagcggctgaagactgacactgtccgatcgcctcggaaccccccagaccatcacggacaccgagcttcgggtaactctcacagtggaaggtaagcccgtccccttcttaatcaatacggaggctacccactccacgttaccttcttttcaagggcctgtttcccttgcctccataactattgtaggtattgacggccaggcttctaaacctcctaaaactccccaactctggtgccaaattagacaatactcttttaagcactcctttttagttatccccaactgcgcagctcccttattagggtgagacactgtaactaaattatctgcttccctgactattcctggactacagctatatcccattgctgcccttcttcccaatccaaagcctcctttgcgtcctcctcttgtatcccccccaccttaacccacaagtataagatacctctactccctccttggcaaccaatcatgcaccccttaccatctcattaaaacctaatcacccttaccccactaaacaccaatattgcatcccacagcacgctttaaaaagatttaagcgttatcactcgcctgctacagcatggccttttaaagcctataaactctccttacaattcccccattttacctgtccgaaaaccagacaagccttacaagttagttcaggatctgcgccttatcaaccaaattgttttgcctatccaccccatggtgccaagcccatatactctcctatcctcaatacctgcctctacaacccattattctgttctagatctcaaacatgctttctttactattcctttgcacccgtcatcccagcctctcttcgctttcacttggactgaccctgacacccatcaagctcagcaaattacctaggctgtactgccgcaaagcttcacagacagcccccattacttcaatcaagcccaaatttcttcctcatctgttacctatcgcagcataattctcataaaaacacacgtgctctccctgccgatcgtgtccaactaatctctcaaaccccaaccccttctacaaaacaacaactcctttccttcctgggcatggttagatactttcgcctttggatacctggttttgccatcctaacaaaaccattatataaactcacaaaaggaaacctagctgaccccatagatcctaaatcctttccccactcctctttccgttccttgaagacagctttagaaactgctcccactctagctctccctgactcatcccaacccttttcattacacacagccgaagtgcaggactgtgcagtcggaattcttacacaaggaccaggatcgcgtcctgtagcctttttgtccaaacaacttgaccttactgttttagcctagccctcatgtctgcatgcagcggctgccactgctttaatacttttagaggccctcaaaatcacaaactatgctcaactcactctctacagttctcacaacttccaaaatctattttcttcctcatacctgacgcatacactttctgcttcccggctccttcagctgtactcactctttgttgagtctcccacaattaccgttgtccctggcccagacttcaatccggcctcccacattattcctgataccacacctgacccccatgactgtatctctctgatccacccaacattcaccccatttccccaaatttccttctttcctgttcctcaccctgatcactcttgatttattgatggtggttccaccaggcctaatcgtcacacaccagcaaaggcaggctatgctatagtacaagccactagcccacctcttagaacctctcatttcctttctatcgtggaaatctatcctatcctcaaggaaataacttctcagtgttccatctgctatcctactactcctcagggattattcaggccccctcccttccctacacatcaagctcgaggatttgcccccacccaggactggcaaattagctttactcaacatgcccgagtcaggaaactaaaatacctcttagtctaagtagacactcactgaataagtaaaggcctttcctacagggtctgagaaggccaccgcagtcatttcttcccttctgtcagacataattcctcagtttagccttcccacctcaatacagtctgataacagatgagcctttattagtcaaatcagccaagcagtttttcaggctcttagtattcagtgaaacctttatatcccttatggtcctccgtcttcaagaaaagtagaatggactaaaggtcttttaaaaacacacctcaccaagctcagccaccaacttaaaaaggactggacaatacttttaccactttcgcttctcagaattcaggcctgtcctcggaatgctacagggtacagcccatttaagctcctgtatagacgctcctttctattaggccccagtcccattccagacaccagaccaacttagactgtgcccccccgaaaaaaaaaaaaacttgtcatccctactattttctgtccagtcatactcctgttcaccattctcaactactcatacatgccctgctcttgtttacactgccggtttacactgtttttccaagccatcacagctgatatctcctggtgctatccccaaactgccactctaaactcttgaagtaaataaataatctttgctggcaggactatgccgaatctccttaagcactctctaatcagatatcctgagttgtcccaattcttagatcttttatacctgtttttctccttctgttattccatttagtttttcaattcatacaaaaccatatccaggccatcaccaatcattctatatgacaaatgtttctcctaacatccccacaatatcaccccgtaccacaagacctcccttcagcttaatctctccaactctaggttcccacgccgcccctaatcccgcttgaagcagctctgagaaacattgcccattctctctccataccaccccctaaaaattttcgccgccccaacacttcaacactattttgttttatttttcttattagtataagaaggcaggaatgtcaggcctctgagcccaagccaagccatcgcatcccctgtgacttgcacgtatacgcccagatggcctgaagtaactgaagaatcagaaaagaagtgaatatgccctgccccaccttaactgatgacattccaccataaaagaagtgtaaatggccggttcttgccttaagtgatgacattaccttgtgaaagtccttttcctagctcatcctggctcagaaaacacccccaccgagcaccttgcgacccctactcctgcccgccagagaacaaaccccctttgactgtaattttcctttacctacccaaatcctataaaacggccccacccttatctcccttcgctgactctcttttcggactcagcccgcctgcacccaggtgaaataaacagccatgttgctcacacaaagcctgtttggtggtctcttcacacggacgcgcatgaaa

SEQ ID NO: 745 - DNA, 5673 bp, Homo sapiens
gtcaggcctctgagcccaagctaagccatcatatcccctgtggcctgcacgtatatatccagatggcctgaagtaactgaagaatcacaaaagaagtgaaaatggcctgttcctgacttaactgatgacattaccttgtgaaattccttctcctggctcgtcctggctcaaaagctcccccactgagcaccttgtgtcccccacccctgcccaccagagaacaaccccctttgactgtaattttccattacctacccaaatcctataaaacggccccacccctatctcccttcgatgactgtctttttggactcagacctcctgcacccaggtgaaataaacagcctcgttgctcacacaaagcctgtttggtggtctcttcacatggacaccagtgaaatttggttccgtgactcggatcaggggacctctcttgggagatcaatcccctgtcctcctgctctttgctctgtgagaaagatccacctatgacctctggtcctcagactaaccagcccaaggaacatctcaccaattttaaatctggtaagtggcctctcttcactctcttctccaacctctctcactatccctcaacctctttcttctttcaatcttggcaccacacttcaatctctcccttctcttaatttcagttcctttccttttctcgtagagacagagatgatgcattttatctgtggacctgaagctccagcaccagtcacggacttgggtttaatcatgtggggatgcctgcctgattatttacccacatttcattggtgtctgatcaccacggggatgcttgccttggtcattcacccacattccttggtggcaagtgaattgcgggggcgcctgctttggctgctcacccacattgcagcccagggctgctcacccaaccccttctctccatgtacccaccccttctccactttcctggggggcaagcacctcccaccccttttacacttttctggggggcaagcaccccccactccttctctctgtgtctctactctctcttttctctgggcttgcctccttcattatggacaaccttccaccttccattcctccttcttctcccttagcctgcattctcaaaaacttaaaacctcttcaactctcagctgacctaaaatctaagcatcttattttcttctgcaacactgcttgaccccaatacaaactcgacagtggttccaaatagccagaaaatggcacttttgatttttccatcctacaaaatctagataattcttgtcgtaaaatgggcaaacggtctgaggtccctgatatccaggcattcttttacacattggtccctccctagtctctgttcccaatgcaactcatcccaaatcttgcttctttccctcctgcctgttctctcagtcccaaccctaatcatcactgggtctttccaatcttccttttctacagactcatctgacctgtcccctcctcaccaggctgctccttgccaggccgagctaggtcccaattcttcctcagcctctattccctgaccctataattcttttttcacctcccctcctcacacccggtctggtttacagtttcgttccacaactagccctcccccacctgcccagcaatttcctcttaaaaaggtggctggagctaaaggcgtagtcaaggttaatgttcctttttctttatctgacctctcccaaatcagttagcatttaggctctttttcatcaaatataaaaacccagcccggtccatggcccttttggcagcaaccctgagactgtttacagccctagaccctgaagggtcagaaggccatctcattctaaatatgcattttattacccagtcagctcctgacattagaataaagctccaaaaattaaattccagccctcaaaccccacaacaggacttaattaaccttgccttcaaggtgtacaataatagagtagaggcagccaagtagcaatgtatttctgaattgcaattccttgcctccactgtgagacaaaccccagacacatctccagcacacaagaactccaaatgcctgaaccgcagctgccaggggttcctccagaacctcctcccccaggagcttgctacaagtgccagcaatctggcctctgggccaaggaatgcctgcagcctgggcttcctcctagccatgtcccatctgtgcaggaccccactggaaattggactgtccaacttgccccgcagccagtcctagggcccctaaagctctagcccaaggctctctgactgactcctccccagatctgctcagcttagcagctgaagactgatgctgaccaatcacctcggaagccccctggaccatgatggacactgagctttgggtaactcttatggtggagggtaagtccgtccccttcttaatcaatacggaggctacccactccacattaccttctttccaagggcctatttcccttgcctccataactgttgtgggtattgatggcccagcttcaaaaccccttaaaattcccccactctggtgccaacttggacaacattcttttatgcactcttttttcagttatccccacctgcccagttcccttattaggccaagatattttaaccaaattatctgcttccctgactattcctggactacagccacatctcattgccgtccttcttcccaacccaaagcctcctttgcgtcttcctcttgtatcccccaaccttaacccacaaatatggaatacctctactccctccctggcaaccgatcacatgcccattactatcccattaaaatctaatcacccttaccctactcagcgccaatatctcatcctgcagcatgctttaaaaggattaaagcctgttatcactcacctgctacagcatgggcttctaaaacctataaattctgcttacaatacccccatcttacctgtcctaaaaccagacaagccttacaggttagttcaggatctgcgccttatcaaccaaattgttttgcctatccaccccgaggtgccaaacccatatactctcctatccttaatacctccctccacaacccattattctgttctagataaacctagctgaccccataaatcctaaatcctttccccactcccctttccattccttaaaaaacagccctaaaagctgctcctatgctggctctccgtaactcttcactcccttttcattacatacagctgaagtgcagggctgtgtggtcggaattcttatacaaggaccaggactgcgccctgtagcccttttatccaaacaacttgaccttactgttttagcctagccctcatgtctgtgtgtggtggctaccactgtgttaatgcttttagaggccctcaaaatcccaaactatgctcagctcactctctacagttctcataatttccaaaatctattttcttcctctcacctggctccttcagctatactcactcttagttgagtctcccacaattaccattgttcctggcctggacttcaatctggcctcccacattattcctgataccacacctgacccccatgactgtatctctctgatccacctgacattcaccccatttccccatatttccttctttcctgttcctcaccctgatcacacttggtttatcaatggcagttccaccaggcttaatcgccacacaccagcaaaggcaggctatgctatagtatcttccacatctatcattgaggctaccgctctgccccccactatctctcagcaagctgaactcattgcctgaacttgggccctcactcttgcaaagggactacaaatcaatattaatactgactctaaatatgccttccatatcctgcaccaccatatgggcagaaagaaatttctcactatgcaagggtcctccatcattaatgcctctttaaaaaaaaaacatttctcaaagctgctttacttccaaaggaagctggagtcattcactgcaaaggccatcaaaaggcaccagatcccatcgctcaggacaatgcttatgctcataaggtagctaaaaaagcagccatcaaaaggcatcagatcccatcactcaggacaatgcttatgctgataaggtagctaaaaaagcagctagcattccaacttctatccctcacggcagtttttctccttctcatctgaccactcccacctactccccactgaaacttccacatattaatcttttcccacgtaaggcaaatggttctttgaccaaggatctccttccagcctcacaggcccattctattctgtcatcatttcgtagtctcttccatgtaggttacaagccactagcccatctcttagaacctctcatttcctttccatcgtggaaatctatcctcaaggaaatcacttctcagtgttccatctgctattccactactccccaggaatttctcaggccccctcccttctctacacatcaagctcggggatttgccctgcccaggactggcaaattgactttactcacatgccccgagtcaggaaactaaaatacctcttggtctgggtagacactttcactggatgggtagaggccttttccacagggtctgagaaggccaccatggtcatttcttcccttctgtcagacataattcctcgttttggccttcccacctctatacagtctgataacggaccagcctttattagtcaaatcacccaagcagtttctcaggctcttggtattcagtggaaccttcataccccttatcatcctcaatcttcaggaaaggtaaaatggactaatggtcttttaaaaacacacctcacgaagctcagccaccaactttaaaaaaaggactctgtcaagaatagagcccaaaaactcaccaaccaaacaagtaattacactgaacccccttggacactctctaattggatgtcctgggtcctcccaattcttagtcctttaatacctatttttctccttcttttatttggaccttgtgtcttctgtttagtttctcaattcatacaaaaatgcatccaggccatcaccaatcattctatatgacaaatgcgccttctaacaaccttaccgcaaaatcttccttcagcttaatctctcccactctaggttcccacgctgcccctaattccactcgaaccagccctgagaaacatcactcatcatctctccataccaccccccaaaattttcaccaccccaaaactttaccaatattttgttttttgttatttttcttattaatataaggagacaggaatgtcaggcctctgagcccaagctaagccatcatatcccctgtgacctgcacgtatacatccagatggcctgaagtaactgaagaatcacaaaagaattgaaaatggcctgttcctgccttaactgatgatattaccttgtgaaattccttctcctggctcatcctggctgaaaagctcccccactgagcacattgtgacccccgcccctgcctgccgagaactacccactttgactgtaattttcctttacctacccacatcctataaaacggccccaccctatctcctttcactgactctcttttcggactcagcctgcctgcacccaggtgaaataaacagccttgttactcacacaaagcctgtttggtgggctcttcacacggacacgagtgaaa

SEQ ID NO: 746 - DNA, 451 bp, Homo sapiens
gtcaggcctctgagcccaagctaagccaccgtaacccctgtgacctgcacgtatacatccagatggcctgaagtaactgaagaatcacaaaagaagtgaaatgtaaatggcctgttcctgccttaactgatgacattccaccacaaaagaagtgaaaatggccggtccctgccttaactgataaccttgtgaaattccttctcctggctcatcctggctcaaaagctcccccactgagcaccttgtgaccccaccccgcccgccagagaacaacccccctttgactgtaactttcctttacctacccaaatcttataaaaacggccccacccctatctccctttgctgactctcttttcggacttagcccgcctgcacccaggtgaaataaacagccttgttgctcacacaaagcctgtttgatggtctcttcacatggacgcaagtgaaa

SEQ ID NO: 747 - DNA, 2606 bp, Homo sapiens
ccactactactgctgccctcctacccccaaacttgcctagttcataagacaggaggaaagagagaaagcaaaaagttagaaagaaacaaaagtaagataaatagccagacaaccttggcaccaccacgtggccctaggagttaaaataataataataataataataacatcaacccctgacctaaactacttgtgttatctttaaattccagacattgtatgaaaaagcattgcaaaactttctgttctgttagctgatccatgtagcccccagtcacgtttcccacacttgctcgatttatcacgaccctttcacatggaccccttaaagttgtaagcctttaaacaggccaagaatttctttttcggggggctccgctcttaagccacaagtctgccagtgcttccggccgaataaacctctttcttctttaatccggtgtctgaggagttttgtctgcagctcgtcctgctacatttcttggttccctgactgagaagcgaggtgattaagggacgttcaagccagccccttaggcagcttatgcctgccctgtagagcatccctgtggggggctccagccagcttgcgcgatgcagatcctgagagtgctcccgggtaggcatttgcccccgtggaatgcctcgtcagagtggtgcatggcaagcccccgtggaggatcaacgcagtggctgaacactgggaaggaactagcactttaagtctggacatttgaaacttggtaagactggtctttggaacttgcacactccatttgagtggaagcgtggcctgatcacccatggcgtgcctgtaccggcactttggtttttgtttttgacttgacttgaaatgcttgatactttggtttttgtttttgacttgacttgaattacttgataaacaggcgtgcctttattggcactttggctttggttctgattttgacttggcttaaattccttgacaaacaggtgtgcctttaatgacactttggttttagttttgattttcctttagtgtgaattagacgagtgagtaaccttttaccctttccttcttgtagtgtgaatgttgttttgtctcaagagaaaaataggtcaaacacaaagtaagcccactccgctagaaactgtgttaaaaaaaaatttcaagaagaaaaataaaaggaaagtcatctaatcatcaaaacttactctattaaaatgcatgttacagaaccttaagaaaggttttgcaggggattacagaggttaagcccccagaggttaagaactctatgtgaattagaattgccctcttttgctgggcgcggtggctcacgcctataatcccagcactttgggaggccgaggcgggcagatcacgaggtcaggagattgagaccatcctgactaatagggtgaaaccccatctctactaaaaatacaaaaacaaaaaattagccaggcgtgctggcgggcacctgtagtcccagctactcaagaggctgaggcaggagaattgcatgaacctggcaggcggagcttgcagtgagtggagattgtgccactgcactccagcctgggcaacagagcgagactccgtctcaaaaaaaagaaaaaaaaaaaagaattgccctcttttggtgttggatggcccaccgaaggaactacagacagggaacaattggccatgtatttaaggtggtgacaggggttggaggacagccagtggacctagatcaattcctttatattgattcatggttaaatataatatagacaaaaaccagcataaatttagccctgtttaacagcttattgcaaaaaagccaaaagtgaaagtaagaacagctgcaccagcagacacagagttgaaaaggggagtcccagaaagagcaagagaagccagttttgcaggagccgccagagataacagaaattctttctccatatggcccagcctacccccctttaccgaggccaacagccccctgagaaacgagattaaggagctaacatgccccaggtctcaccttgaaggggaagatcggagcctcaagaggccaaggaaggaagtcaagatagtcaagtgggccctctcagatctggtcttgctggagctatgcaaatgcctctcagggagacacgaggacctgtctattataatgaccaagcccacatccagggggtggggcaacagactttcatctatcagccctttttaaccattgatctactaaactggaaacaccctgaacccgccaccttgttcccagcagctagagccctgtcgagcattaactgtgtagaggtgttggactcaagtttactctagcagacctgacctccgagaccagccttgggcatcagtagactgggagctatacatggacgggagcagcttcatcaacccacaaggagagagatgtgcaggatatgcagtgataaccctggacactgtcgttaagctgagctcattgctttaattcaggccttagaactcagtgaaggtaagactaaacatttacactgactctcagtatgcctgtttaaccctccaactgcatggagaattatatttaaaaaagggcctgttaagatctaggaaaaaggggaaaaaa

SEQ ID NO: 748 - DNA, 4616 bp, Homo sapiens
gtcaggcctctgaggccaagctaagccatcatatcccctgtgacctgcacgtacacatccagatggctgattcctgccttaactgatgacattccaccacaaaagaagttaaaatggcctgttcctgccttaactgatgacattatcttgtgaaattccttctcctggctcatcctggctcaaaagctcccctactgagcaccttgtgacccctactcctgcctgctagagaacaacctgcctttgactgtaattttcctttacctacccaaatcttataaaacggccccacccctgtctcccttcgctgactctcttttcggactcagcctgcctgcacccaggtgattaaaagctttattgtttacacaaagcctgtttggtggtctcttcacatggacgcaagtgagtgaaatttggtgccatgactcagatcaggggaccctccttgggaaatcaaccccctgtcctcctgctctttgctctgtgagaaagatacacctacgacctctggtcctcagacagaccagcccaaggaacatctcaccaatttcaaatccggtaagcggcctctttttactctcttctccaacctccctcactatccctcaacctctttctcctttcaatcttggggccacactgcaatctctcccttctcttaatttcagttcctttcattttctggtagagacaaaggagacacattttatccgtggacccaaaactccggcgccagtcacggacaccggaaggcagccttcccttgttgtttaatcattgtggtgacacctctctgattattcacccatgttccattggtgtctgatctccacggggatgcctgccttgattattcacccacattcccttggtggcaagtcaattgcggggacatctgctttggctgctcacccatgttgcagcccagggctactcctcacccccttctccgtgtctctacccttctccttaaacttgcctccttcactataggcaaacttccaccctccattcctccttcttctcccttagcctgtgttcttaagaacttaaaacctctccaattctcacctgacctaaaatctacgcatcttattttcttctgcaacactgcttgtccacaatacaaacttgacaatggctctaaaaggccagaaaatggcatttttgattatctccatcctacaagacctaaataattcttgtcataaaatgggcaaacggtctgagatgcctgacgtccaggcattcttttacacactggtccctcccgtctctgttcccaatgcaacttatcccaaatcttccttccctcccgcctgtcccctcagtcccaaccccaagtgttactaagtctttctaatcttccttttctacagacccatctgacctctcccctccttgccaggccgagctaggtcccaattcttcccccagcctctgctcctccaccctatgatccttttatcacctcccctcctcgcacccggtccagcttacagttttgttcggtgactagccctccccgacctgcccagcaattccctcttaaaaaggtggctggagctaaaggcatagtcaaggttaatgctcctttttctttatccgacctcttccaaatcagttagtgtttagactctttcatcaaatatgaaaaaccaagcccagttaacggcttgttcggcagcaaccctgagatgctttacagccctaaacactaaaaggtcaaaaggccgtcttattctcaatatatattttattacccaatctgctcctgacattaaataaaactccaaaaattaaattctggccctcaaaccccacaacgggacttaattaacctcgccttcaaggtgtacaatagaagagtagaggcagccaagtaacaatgtatttctgagttgtaattccttgcctccactgtgagacaaaccccagccacatctccagcatgcaagaacttccaaacacccgaaccgcagtggccaggcattcctccagaactgcctcccctaggagcttgctacaagtgccagaaatctggccaccaggccaaggaatgcctgcagcccgggattcctcctaagccgtgtcccatctgtgtgggaccccactggaaatcggactgtccaactcatccggcagccactcccagagcccctggaactctggcccaaggctctctgactgactccttcccagatcttctctacttagcagctgaagactgacactgcttgattgcctcagaagcctacaggaccatcacagacactctgggtaactcttacagtggaaggtaagtccgtccccttcttaatttatatggaggctacccactccatattaccttcttttcaagggcctgtttccctttcaagggcctccataactgttgtgtgtgttgacggccaggcttctaaacctcttaaaactccccaactctggtgccaacctagacaatactcttttaaacactcctttgtggttatccccacctgcccagttcccttattaggctgagatactttaactaaattttctgcttccctgactattcctaggctacagccacgcctctttgtcaccttttcccccagttcaaagcctccttcacatcctccccttgtatctccccaccatagcccacaagtataggacacctctactccctccttggcaactgatcatgcaccccttaccatctcattaaaacctaatcacccttaccccactcaatgccaatatcccatcccacagcatgctttaaaaagattaaagcctgttatcactggcctgttacagtatggccttttaaagcctataaactccccttacagtttccccatttcacctgtcctaaaaccagacaagacttacaggttggttcaggatctgcgccttatcaaccaaattgttttgcctatccaccccttggtgccaaacccatatactctcctatcctcaatacctccctctactacccattattctgttctggatctcaaacatgctttctttactattcctttgcacccttcatcccagcctctcttcactttcacttggactgaccctgacacccatcaggctcagcaaattacctgggctgtactgccacaaagcttcgcagacagcccccattacttcagtcaagtccaaatttcttcctcatctgttacctatctcagcataattctcataaaaatacacgtgcactccctgccgatcgtgtccaactgatctctcaagccccagcaccttctacagaacaacaactcctttccttcctaggcatggttagatactttcaactttagatacctggttttgccatcctaacaaaaccattatataaactcacaaaaggaaacctagctgaccccatagatcctaaatcctttccccactcctctttccattccttgaagacagctttagagactgcccccaccctagctctgcctgactgatcccaaccctattcattacccacagccgaagtgcagggctgtgcagtcagaattcttacacaagaaccaggaccgcaccctgtagcctttttacccaaacaacttgaccttactgttttgcctagccctcaagtctgtgtgcagcagccaccgctgccctaatacttttagaggcccttaaaatcacaaactatgctcaactcactctctacagttctcataacttccaaaatctattttcttcctcacacctgacacatatactttctgctccctggctccttcagctgtactcactctttgttgagtctcccacaattaccattgttcctggcccggacttcaatccagcctcccacattattcctgataccacacctgaccccccatgactgtatctctctgatccacctgacattcaccccatttccccatatttccttctttcctgttcctcaccctgatcacacttggtttattgatggcagttccaccaggcctaatcgccacacaccagcaaaggcaggctatgctacagtacaagccgctagcccgcctcttaaaacctctcatttcctttccatcgtggaaatctatcctcaaggaaataacctctcagtgttccatgtgctattctactgcttctcaaggattattcaggccccctcccttccctacacatcaagctcagagatttgcccctgcccagaactggcaaaatgactttactcacatgccccaattcaggaaactaaaatacctcttggtccgggtagacactttcactggataggtagaggcctttcccacaaggtctaagaaggccaccatggtcatttcttcccttctgtcagacataattcctcggtttggccttcccacctctatacagtccgatagcagaccggcctttattagtcaaatcagccaagcagtttttcaggctcttagtattcagcaaaacctttatataccttacagtcctccgtcttcaggaaaggtagaacaaccaaaagtctttcaaaaacacacctcaccaagctcagccaccaacttaaaaaggactggacaatacttttaccactttcccttcgcagaattcaggcctttcctcagaatgctacagggtacagcccattt

SEQ ID NO: 749 - DNA, 712 bp, Homo sapiens
aagagacaggactagctggatttcctaggctgactaagaattcctaagcctagctggggaaggtgaccgcacccacctttaaacacggggcttgtaactaagcacacaccaggccaatcaggtagtaaagagggctcactaaaatacaaattaggctaaaaacagggggtaaagaaataatcaaatcatgtatcgcctgagagcacagggggagggacaatgatcgggatataaacccaggcattcgagcccaatcggggtacccctttgggccccctcctattttatgggagctctgttttcactctattaaatgttgcagctgtacgctcttcccctccgtgtttgttctggctggagctgagcttttgctcaccgtccaccactgctgatcgccgtcgtcgcagacccatcactgacttccacccctccggatccagcagggtgtcccctgagcttctgatccagggaggcgcccattgctgctccggatagggctaggggatcgccattgttcctgcgcagctaagtgcccaggttagtcctaattgagccgaacactagacgctgggttccacagttctcttcagtgacccacggcttctaatagagctataacactcaccgcacggcccaaggttccattccttggaatccctgaggccaagaaccccaggtcagagagcaagaggcttgccaccatcttgggagc

SEQ ID NO: 750 - DNA, 968 bp, Homo sapiens
ggtatgtgtggggaaaagcaagagagatcagactgttactgtgtctgtgtagaaagaagtagacataggagactccattttgttctgtactaagaaaaattattctgccttgagattctgttaatctatgaccttaccaccaaccccgtgctctctgaaacatgtgctgtgtcaaactcacggttaaacggattaagggttgtgcaagatgtgctctgttaaacagatgcttgaaggcagcatgctccttaagagtcatcaccactccctaatctcaagtacccagggacacaaaaactgtggaagcctgcagggacctctgcctaggaaagccaggtattgtccaaggtttctccccatgtgatagtctgaaatatggcctcgtgggaagggaaagacctgaccatcccccagcccgacatccgtaaagggtctgtgctgaggaggattagtataagaggaaggcatgcctcttgcagttgagacaagaggaaggcatctgtctcctgcccgtccctgggcatggaatgtctcagtataaaacccgattgtacgttccatctactgagatagggaaaaaccgccttagggctggaggtgggacatgtgggcagcaatactgctttgtaaagcattgagatgtttatgtgtatgcatatctaaaagcacagcacttgattctttaccttgtctatgatgcaaagacctttgttcacgtgtttgtctgctgaccctctccccactattgtcttgtgaccctgacatagccccctctcggagaaacacccacaaatgatcaataaatactaagggaactcagaggctggcgggatcctccatatgctgaacgctggttccccggatccccttatttctttctctgtactttgtgtctttttcttttccaagtctctcattccacctaacgagaaacacccacaggtgtggaggggcaacccaccccttca

SEQ ID NO: 751 - DNA, 618 bp, Homo sapiens
accgacaagacatgtcaggcaatcctcaggtgataggcagttgttaaactgtctctttaaaataataattggtcacagccaatgccagggaaaggcactctcccaagagataaacacctgaagctggtgatcagtgacttcctgatatgacctcaggagtggagcgagtggtctcacgcatgcacactaagaggcaaaatggtggagttttactggtatatgacctgcctctaagaatactccaccggtaaaggaaaaacgcctcaagtgagcatgcatagaacttcagtaaacacactgtgcacatggcccctccaaagtgctggcagaccactcagcatgcggacagcctaccccaagggaagaatcgggcaagaagagacacagacaccagaagaatgccaacatataaaagcccaagtcaaaggtctaactgcacactcaagtcacccacttggtcctcttccaagtgtactttacctccttttgttcctgctctaaaactttttaataaactttcactcctgctctaaaaatgggctcagcttcttactctgccttttgttcccttggttgaatcatttcttctgaagaggtaagaattgaagttgctgcaga

SEQ ID NO: 752 - DNA, 771 bp, Homo sapiens
gagagacaggactagctggatttcctaggctgactaagaatccctaagcctagctgggaaggtgaccgcttccacctttaaacacggggcttgcaacttagctcacacataaccaatcagatagtaaggagagctcactaaaatgctaattaggcaacaacaggaggtaaagaaatagccaatcatctcttgcctgagagcacaggggaagggacaatgctcgggatataaacccaggcattcgagccggcaacagcaaccccctttgggtcccctccctttgtatgggagccctgttttcactctattaaatcttgcaactgcactcttctggtccgtgtttgttacagctcgagctgagcttttgctcgccgtccaccactgctgtttgccgccgttgcagacccacgactgacttccatccctccagatctggcagggcacctcctgatccagcgaggtgcccattgccactcccaatcgggctaaaggcttgccattgttcctgcacggctgagtgcgtgtgttcatcctaatcaagctgaacactagtcactggattccacagttctcttccatgacctgcggcttctgatagagctataacactcaccgcatggcccaagattccattccttggaatccgtgaggccaagaaccccaggtcagagaatacaaggcttgccaccatcttggaagcggcccgtcgccatcttggaagcggcttgccaccatcttgggagctctgtgcgcaaggaccccccagtaaca

SEQ ID NO: 753 - DNA, 5287 bp, Homo sapiens
gtcaggcctgagcccaagctaagtgatcatatcccctgcgacctgcacatatatatccagatggcctgaagcaactgaagaaccacaaaagaagtgaaaatagccagttcctgccttaactgatggcattccaccactgtgatttgttcctgccccaccctaactgaccaattgaccttgtgacattccttctccggggcaatgaatctcaggagctccccaccaagcatcttgtgacccccactcctgcccacaagagaacaaccccctttaactgtaattttccactacctacccaaatcctataaaactgtcccaccccatctctctccctttgctgactcctttttcagattcgcccacctacgcccaggtgattaaaaagctttattgctcacacaaagactgtttggtggtctcttcacacggacgcatgtaacatttggtgctgaagacctgggacagggggattccttcaggagactggtcccctgtcctcgccctcactccttgaggagatccacctacgaccttgggtcctgaaatcagcccaaggaacatctcaccaatttcaaatcaggtaagtggtctcttcactctcttctccagcctctctcactacccttcagtctccctgtgcttccaattccagctctttttcctctctagcagagacaaaggagacacattttatccgtgaactcaaaaactccaacgtcggtcacaaatttaggaagacagtcttcccttggtgtctgatcactgcagggatgcctgccttgatcattcacccacattccattggtgtctgatcactgcggggatgcctgccttggtcatttacccacatttccttggtggtaagtcaactgtggggatgcctgctttggctgctcacccatattacagcccagggctgctcacccctgccctccaccctgtgtctctacctttctctttagacttacctccttcactatgggcaactttctgccctccattcccccttcttctcccttagcctgtgttcttaaaaacctaaaaccccttcaactaacacctgacctaaaacctaaacatcttattttcttctgtaataccacttggccccaatacaaactcgaaaatagttccaagtggccagagaatggcactttcgatttgtctatcctacaagacctagataatttttgtcgaaaattgggcaaatggtctgaggtgcctgacgtctaagcattctttacacattggtccctccctagtctctgctcccaatatgactcgtcccaaatctttcttctttctctcctgtctgttccttcaggctccaccccaagctctgagccctttgaatcctccttttctacagacccatctgacctttccccattccccaggctgctcctcgccaggccaagccagatctcaattcttcctcagcctctgctcctccaccctataatccttctatcacctcccctcctcacacccggtccggcttacagtttcgttccgtggctagccctcccctacctgcccaacaatttcctcttacagaggtggctggagctgaaggcatagtcaaggttaatgctcctttttctttatccgacctctcccaaatcagttagcgtttaggctctttttcatcaaatataaaaacccagcccagtccatggcctgtttggcaacaacccttagacactttaccaccctagatccagaggggccagaaggccgtcttattcttaatatgcattttattatccaatccactcctgacattagaaaaagctccaaaaattagattccggccctcaaaccccacaacaggacttaattaaccttgccttcaaggtgtacaataatagagaagaggcagccgagcggcagtgtatttctcaattgcaattacttgcctccactgtgagagaaaccccagccacatctccagcacataagaacttcaaaacgcctaaaccatagcagtcaggcattcctcctggactttttcccccaggatcttgctccaagtgctggaaatctggccagtgggccaaggaatgcccacagcctgggattcctcctaagccatgtcccatctgtgcaggaccccactggaaatcagactgtccaacttgcccagcagccattcctagagcccctggaactctggcccaaggctctctgactgactccttcccagatcttctcggcttatcagctgaggactgacgctgcccaatcgcctcgcaagcctcctggaccatcacagacacttcaggtaactgctacagtggagggtaagtccatccctttcttaattgataaggaggctacccactccacattaccttcttttcaagggcctgtttcccttgcctccataactgttgtgggtattgacggccaggcttctaaacctcttaaaactcccccactctggtgccaacttggacaacattcttttatgcactcttttttagttatccccacctgcccagttcccttattaggccgagtcattttaaccaaattatctacttccctgactattcctgggctacagccacatctcattgctgcacttttacccaactcaaggcctcttttacatcctccccttgtatctccctaccttaatccataattatgggatacctctactccctccttggtgaccaatcatgcataccttatcatcctgttaaaacctaatcacccttaccccactcaatgccaatatcccatcccatggcatgctttaaaagggttacaactcccctatcctacctgtccaaaaactggacaagtcttgcaggttggttcaggatctttaccttattaatcaaatcatccttcccatctatcctatagtgccaaacccatatactctcctatcctcaatacctccctccacaacccattattctgttctggatctccaagatgctttctttaccattcctttacacccttcatcccagcctctcttcgctttcacttggactaaccctgacacccatcagtctcagcaacttacctgggctgtactgctgcaaggcttcagggacagccctcattacttcagccaagctctttctcatgatttaatttatttccacccatgtgcttctcaccttattcaatatattgatgaccttctactttgtagcccctcctttgaatcttctcaacaagacacactccagctccttcaacatttattctccaagagatattgggtatccccctccaaagctcaaatttcttctccacccgttacctacttcagcataattcttcatgaaaacacatgtgctctccctgccgatcatgtccggctaatctctcaaaccccaaccccttctacaaagcaacaactcctttccttcctgggcgtggttggatactttcgcctttggatacctggttttgccatcctaacaaaaccattatataaactcacaaagggaaacctagctgaccccatagatcctaaatcctttccccactcctctttccattccttgaaaacagctctagagactgctcccacactagctctccctgactcatcccaacttttttcattacacacagctgaagtgcagggctgtgcagtcagaattcttacacaaggaccaggactgagccctgtagcctttttgtccaaacaacttgaccttactgttttaggctggccctcatgtttgcatgcggcggctgctgctgctctaatacttttagagaccctcaaaatcacaagctatgttccacttactctctacagttcccataactttcaaaatctattttcctcctaatgttggatgcctataccgcccccccggctccttcagctgtactcactatttgttgaatctcccacaattaccattgttcctgggccagacttcaatccagcctctcatcttattcctgatactacatctgagtcccatgactgtatctctctaatccacatggcattctccccatttccccatatttccctctttcctgttccccacctaggccacacttggtttattgatggtagttcctccaggcccagtcaccaatcaccagtaaaggcaggctatgctatagtgtcttccacatctatcattgagtctatggccctgcccgcttccactacctctcaacaagctgaactcattgccttaacttgagctgtcattcttgcaaagggactacgtgtcaatatctatacagattccaagtatgccttccacatccttcaccaccatgctgttatatgggcagaaagaggtttcctcactacacaagggtcctccattattaatgcctccttaataaataaactcttcttaaagctgctctacttccaaggaagctggggtcattcactgcaaggggcatcaaagggcatcagatcccatcactaaggacaatgcttatgctgataaggtacctaaagaagcagctagcaaacagcttcctgttcccctcatgacaccaacacttcactactattttgttttgtttttcttattattaatataagaagacaggaataggcctcgacttactgctaaaaaaggaggactctgtatatttttaaatgaagagtgttgtttttacctaaatcagtctggcctggtatatgacaacataaaaaactcaaggatagagcccaaaaactcgccaaccaagaaaataattacgctaaatccccttgggtactctctaattggatgtcctgggtcctcccagttcttagtcctttaatacctgtttttctccttctcttatttggacttgtgtcttctgtttagtttctcaattcgtacaaaactgcatccaggccatcaccaatcattctatatgacaaatgctccaacaaccccacaatatcaccccttaccccaaaatctttcttcagtttaatctttcccactctaggttcccacactgccccaatctcactcaaagcaaccctgagaaacattgccattatctctccatatcaccccccaaaattttcgccgccccaacacttcaccaccattttgttttgtttttcttattaatataagaagacaggaatgtcaggcctctgaacccaagctaagccatcatatctcctgtgacctgcacgtatacatccagatggcctgaagcaactgaagaaccacaaaagaagtgaaaatagccagttcctgccttaactgatgacacttcaccactgtgatttattcctgccccatcctaactgatcttgtgacattccttctcctgg

SEQ ID NO: 754 - DNA, 380 bp, Homo sapiens
tcaggcctctgagcccaagctaagccatcatatcccctgtgacctccacgtatacatccaggtggcctgaagtaactgaagaatcacaaaagtgaaaatggcctgttcctgccttaactgatgacattaccttgtgaaattccttctcctggctcagaagctcccccactgagcaccttgtgacccccacccctgcccaccagagaacaaccctctgactgtaattttccactacctacccaaatcctataaaacggccccacccctgtcacctttcgctgactctcttttcggactcagcccgcctgcaggtgaaataaacagccttgttgctcacacaaagcctgtttggtggtctcttcacacggacgcaagtgaaa

SEQ ID NO: 755 - DNA, 5712 bp, Homo sapiens
gtcaggcctctgagcccaagctaagccatcacatcccctgtgacctgcacttatacatccagatggcctgaagtaactgaagaatcacaaaagaagtgatacttaaatggcctgttcctgccttaactgatgacattccaccacaaaagaagtgaaaatggccggtccttgccttaactgatgacattaccttgtgaaattccttctcctggctcatcctggctcaaaaagctcccctactgagcaccttgtgacccctcactccggcctgccagagaacaacccccctttgactgtaattttcctttacctaccaaaatcttagaaaatggccccaccccatctccctttgctgactctcttttcagactcagcccacctgcacccaggtgaaataaacagccttgttgctcacacaaagcctgtttggtggtctcttcacacagatgcgagtaaaatttggtgccatgactcggactgggggacctcccttaggagatcaatccctatcctcctgctctttgctccatgagaaagatcgacctacgacctcaggtcctcagactgaccagcccaaggaacatttcaccaattttaaatcgggtaagcggcctctctttactctcttctccaacctctctcactatccctcaacctctttctcctttcaatcttggcaccacacttaaatctctcccttctcttaatttcagttcctttccttttctggtagagacaaaggtgaagcgttttatctgtgaacccaaaactccggcgccggtcacagaatcaggaagagtcttcccttggtgtttaaccacatggggatgcctacatgattattcacccatgtttcagaggtgtctgaccacggagggatgcctgtcttggtccttcacccttagcggcaagtaccactttttggggggcaagaaccccccgaccccttccctccatgtctctacctcttctccactttcctgggggcaagcatccccccaccccttctctctgtgtctctaccctctattttctctggacttgcctccttcactataggtaaacttccaccctccattctccttctcccttagcctgtgttctcaaagacttaatacctcttcaactcacatgtgacctaaaacctaaatgccttattttcttctgcaatgccacttgaccccaatacaaactcgacagtggttccaaatagccagaaaatggcactttcgatttttccatcctacaagatctaaataatccttgtcgtaaaatgggcaaacagtctgagatgcctgacgtccaggcattcttttacacatcggtccctccctagtctctgttcccaatgcaacttgtcccaaatcttccttctttccctcccacctgtcccctcagtcccaaccccaagcgtcgctgagtctttcttctttccaatcttccttttctatagacccatctgacctctcccctcctccccaggctgctcctcgccaggctgagctaggtcccaattcttcctcagcctccgctcccctaccctataatccttttatcacctcccctcctcacacccggtcgggcttacagtttccttctgcaacaagccctcccgcacctgcccagcaatttcctcttaaaaaggtggctggagctaaaggcatagtcaaagttaatgctccttcttctttatcccaaatcagagagcgttaggctctttttcaccaaataaaaaacccagcccagttcatggctgcttggcagcaaccctgagacgctttacagccctagaccctaaaaggtcaaaaggctgtcttattctcaatatacattttattacccaatttgctcccgacattaaataaaactccaaaaattaaattccagctctcaaaccccataacaggacttaactaacctcgccttcaaggtgtacaataataaagtggaggcagccaagtagcaatgtatttctgagttgcaattccttgcctccactgtgagacaaatcccagccatatctccagcacacaagaacttccaaatgcctggaccacagctgccaggggttcctccagaatctcctccccaagccctggaaatctggccactgggccaaggaatgcccatggcccaggattcttcctaagctgtgtcccatctgttcaggaccccactgaaaatcggactgttcaactcccctggcagccacttccagagcccctggaactctggcccaaggctctctgacaccttcccagaccttcttggcttagcagctgaagactgacactgcccgatcgcctcagaagcctataggaccttcacagatgctctgggtaaccctcacagtggagggtaagtctgtccccttcttaatcaatacagaggctacccactgcacattacctttttttcaagggcctatttcccttacctccataactgttgtgggtattgacagccaggcttctaaacctcttaaaattccccaactctggtgccaacttagacaatatgcttttaagcactcctttttagttatccccacctgcccagttcccttgttaggccaagacactttaactaaattatcttcttccctgactattcctgggctacagccacacctcattgctgccttttcccccagttcaaagcctccttcacatcctccccttatatctccccaccttaacccacaagtataggacacctctactccctccttagcgaccgatcatgcaccccttaccatcccattaaaacctaatcacccttaccccgctcaatgccaatatcccatcccacagcatgctttaaaaggattaaagtctgttatcactcacctgctacagcatggccttttaaagcctataaactccccttacgattcccccattttacctgtcctaaaaccagacaaggcttacaggttagttcaggatctgcaccttatcaaccaaattgttttgcctatccacaccgtggtgcccaacacatatactctctgcctcaatacctccctccacaacccattattctgttctggatctcaaacatgctttctttactattcgtttgcacccttcatcccagcctctcttcgctttcacttggactgaccctgacacccatcaggttcagcaaattacctgggctatactgccacaaggcctcacagacagcccctattacttcagtcaagcccaaatttcttcctcatcagttacctatcttggcttctcataaaaacacatgtgccctccctgccgatcatgtccacctgatctcttaaaacccagcactttctacaaaacaacaattcctttccttcctaggcatggttggatactttcaactttagatgcctggttttgccattctaaaaccattttataaactcacaaaaggaaacctagctgaccccatagatcctaaatcctttccccactcctttccgttccttgaagacagctttagagactgcccccactctagctctccctgactcatcccaacccttttcattacacactgctgaagtgcagggctgtgcagtcagaattcttacacaaggaccaggatggcatcctgtagcctttttgtccaaacaacttgaccttattgttttaagctggccattatgtctccatgcagtggctgctgccgctctaatacttttaaaggcccttaaaatcacaaactatgctcaactcactctctacagctctcataatttccaaaatctattttcttcctcacacctgacgcatatactttctgctccctggctccttcagctgtactcactctttgctgtgtctcccacaattaccattgttcctggcccggacttcaatccagcctcccacattattcctgataccacacctgaccctcatgactgcatctctctgatccacctgacgttcaccccatttccccacatttccttcttccctgtttctcaccctgatcacacttggtttattgatggcagttccaccaggcctaattgccacacaccagcaaaggcaggctatgctgtagcacaagccactagcccgcctcttaaaacctctcatttcctttccattgtagaaaactgtcctcaaggaaataacttctcagtgttccatctgctattctactactcctcaaggattattcaggccccctcccttccctacacatcaagcttaaggatttgcccccacccaggactggcaaattagctttactcaacatgccctgagtcacaaaaactaaaatacctcttagtctaagtagacactttcactagataggtagaggcctttcctacagggtctgagaaggccaccacagacatttcttcccttctgtcagacataattcctcagtttagccttcccacctctatacagtctgataacagaccagcctttattagtcaaatcagccaagcagtttttcagactcttagtattcagtgaaacctttatatcccttacagtcctcagtcttcaggaaaagtagaacatactaaaggtcttttaaaaacacaccttaccaagctcagccaccaacttaaaaaggaatagacaatacttttaccactttcccttctcagaattcaggcctgtcctcagaatgctacaaagtacagcccatttgagctcccatatagatgctcctttttattaggccccagtatcattccagacaccagaccaacttggactgtgccccaaaaaacttgtcatccctactgtcttctgtctagtcatactcctattcactgttctcagctactcatacgtgccctgctcttgtttacactgccagtttacactgtttctccaagccatcacagctgatatctcctggtgctagccccaaaccgccactcttaactcttatagtaaataaataatctttgcaggcaaggctatgctgaacctccttaggcactctctaattagatgtcctaggtcctcccaattcttagtcctttaatacctgtttttctccttgtcttattccatttagtttttcaattcatacaaaactgtatccaggtcatcaccaataattctaaatgacaaatgtttcttctaacaaccccacaatatcaccccttaccacaaaatcttccttcagcttaatctctcccactctaggttcccacgccacccctaatcccgctcaaagaagccctgagaaacatcgcccattatctctccataccacccccaaaaatttttgccgtcccaacactttaccactatttcattttatttttcttattaatataagaagacaggaatgtcaggtctctgagcccaagctaagccatcgtatcccctgtgacctgcatgtacacatccagatggtgggttcctgccttaactgatgacattccaccacaaaagaagtgaaaatggcctgttcctgccttaactgatgacattgtcttgtgaaattccttctcctggctcatcctggctcaaaagctccccaactgagtaccttgtgacccccactcctgcccaccggagaaaaacccccctttttcctttacctaccccaatcctacagaagggccccaccccatctcccttcgctgactctcttttcggactcagcccgcctgcacccaggtgattaaaagctttattgctcacacaaagcctgtttgttggtctcttcacatggacgcgcatgaaa

SEQ ID NO: 756 - DNA, 4222 bp, Homo sapiens
gtcaggcctctgagcccaagccaagccatcacatcccctgtgactagcacgtatacatccagatggcctgaagtaactgaagatccacctcttcaactcacacctgacctaaaacctaaatgctttattttcttctgcaatgccacttgagcccaatacaaactcgacagtagttccaaatagccagaaaatgacactttgaatttttccatcctgcaagatctaaataattcttgtcgtaacataggcaaacggtctgaggtgcctgacgtccaggcattcttttacacatcagtcccttcctagtctctgtgcccaatgcaactcgtcccaaatcttccttctttccctcccgcctgtcccctcagtcccaaccccaagagtcgttgagtctttctaatcttccttttctacagacccatctgacctctcccctcctcgccaggccgagctaggtcccaattcttcctcagcctccgctcctccaccctataatccttttatcacctcccctcctcacacctggtccagtttacagtttcattccatgactagccctcccccacctgcccagcaatttcctcttaaaaaggtggctggagctaaaggcatagtcaaggttaatgctcctttttctttatcccaaatcagaagcgtttaggctctttttcatcaaatataaaaacccagcccagttcatggctcctttggcagcaaccctgagacgctttacagccctagaccctaaaaggtcaaaaggccgtcttattctcaaaatacattttattacccaatctgctcccgacattaaataaaactccaaaaattggaatctggccctcaaaccccacaacaggacttaattaacctcaccttcaaggtgtacaataacagaaaaaagttgcaattccttgcctccactgtgagacaaaccccagccacaacctcagcacacaagaacttccaaacgcctgaactgcagcagccaggtgttcctccagaacctcctcccccaggagcttgctacccgtgccggaaatctggccaccgggccaaggaatgcccgcagcccaggattcctcctaagccgcgtcccatctgtgtgggaccccactgaaaatcggactgttcaactcacctggcagccactcccagagcccctggaactctggcccaaggctctctgactgactccttcccagatcttctcggcttagcggctgaagactgacactgcccgatcgcctcggaagccccctagaccatcacggacgccgagcttcaggtaactctcacagtggaaggtaagcccgtccccttcttaatcaatacggaggctacccactccacattaccttcttttcaagggcctgtttcctttgcctccataactgttgtgggtattgacggccaggcttctaaacctcttaaaactccccaactctggtgccaacttagacaatactcttttaagcactcgtttttagttatccccacctgcccagttcccttattaggctgagacactttaactaaattatctgcttccccgactattcctggactacagctatatctcattgccacccttcttcccaatccaaagcctcctttgcgtcctcctcttgtatccccccaccttaacccacaagtataagatacctctactccctccttggcgaccagtcatgcaccccttaccatctcattaaaacctaatcacccttaccccactcaatgtcaagatcccatcccacagcatgctttaaaaggattaaagcctgttatcactcgcctgctatagcatggccttttaaagcctataaactctccttaccattcccccattttatctgtcctaaaaccagacaaggcttacaagttagttcagaatctgtgccttatcaaccaaattgttttgcctatccaccccatggtgccaaacccatatactctcctatcctcaatacctccctctactacccattattctgttctggatctcaaacatgctttctttactattcctttgcgcccttcatcccagcctctctttgctttcacttagactgaccctgacatgcattaggctcagcaaattacctgggctgtactgccgcaaggcttcacagacagcccccattacttcagtcaagcccaaatttcatcctcatctgttacctatctcagcataattctcataaaaacacacgtgctctccctgctgatcgtgtccgattaatctcccaaacctcaatcccttacaaaacaacaactcctttccttcctaggcatggttagtgcggtcagaattcttacacaagagccaggaccgcaccctgtaacctttctgtccaaacaacttgaccttactgttttagcctagccctcatgtctgcgtgcagtggctgccactgctttaatacttatagaggccctaaaaatcgcaaactatgctcaactcactctctacatttctcataacttccaaaatctattttcttcctcatacctgacgcatatactttctgctccccggctccttcagctgtactcactctttgttaagtcccataattaccattgttcctggcccagacttcaatctagcctcccacattattcctgataccacacctgacccccatgactgtatctctctgatccacctgatattcaccccgtttccccatatttccttctttcctgttcctcaccctgatcacgcttgatttattgatggcagttccaccaggcctaatctccacacaccagcaaagaggcaggctatgctatagtacaagccactagcccgcctctcagaacctctcatttcctttccatcgtggaaatctatcctcaaggaaataacttctcagtgttccatctgctattctactactcctcagggattattcaggccccctcctccctgccctacacatcaagctggaggatttgccccaacccaggactggcaaattagctttactcaacatgccctgagtcaggaaactaaaatacctcttaagtctaaatagacactttcactgaataagtaaaggcctttcctacagggtctgagaaggccaccacagtcatttcttcccttctgtcagacataattcctcagtttagccttcccacctctatacagtctgataacagaccagcctttattagtcaaatcagccaagcagtttttcaggctcttagtattcagtgaaacctttatatcccttacggtcctccgtcttcaagaaaagtagaatggactaaaggtcttttaaaaacacaccacaccaagctcagccaccaacttaaaaaggactggacaatacttttaccactttcgcttctcagaattcaggcctgtcctcggactgctacaaggtacagcccatttgagttcctttttattaggccccagtctcattccagacaccggaccaacttagactgtgccccgaaaaaacttgtcatccctactattttctgtctagtcatactcttattctccgttctcaactactcatacatgccctgctcttgtttacactgccggtttacactctttctccaagccaacacagctgatatctcctcttgctatccccaaactgccactcttaactcttgaagtaaataaataatctttgctggcaggtctatactgaatctccttaggcactttctaatcagatgtcctaggtcctcccaattcttagaccttttacacctgtttttctccttctcttattccatttagtttttcaattcatacaaaaccgtatccaggccatcaccaataattctacacaacaaatgtttcttctaacaaccccacaatatcaccccttaccgcaaaatcttccttcagcttaatctctcccactctaggttcccacgccgcccctaatcccgcttgaagcagccctgagaagcatcgctcattctctctccataccacccccaaaaattttcgccgccccaagacttcaacactattttgttttatttttcttattaatataagaaggtaggaatgtcaggcctctgagctcaagccaagccatctcatcccctgtgacttgcacgtatacatccagatggcctgaagtaactgaagatccacaaaagaagtaaaaatagccttaactgatgacattccaccattgtgatttgttcctgtcccgccctaactgatcaatgtactttgtaa

SEQ ID NO: 757 - DNA, 670 bp, Homo sapiens
acagtaggtagctagtcaagcatgagcagggcaggagagggctccctatacctcaccacaaatgtcaggcaaccatcaggtgatggtcaggtggttgttaactgtctgtttaaaataataattggttgcagctggtgccagggaaaggccgtctcccagtagatagaaacacctgaaacaggtggtcagctgcttaatctcaggagttgggcaactgggctcaagcatgctcactaagaggcaaaatggtgagtttaactgatacatgactttccagggacattcggctggtaagggaagaatgcctcaagtgagcatgcatacaactccagtgaacacactgtgcacactcccctcccaagggctggcaggtcactgtgcacacggacagcccaagggaagaatcaggggagaagggacgcaaggcatgccaacatgtacaaccccaagtcaaaggtgaaatggcacacttgatcactcaagttgcccaggtggctctttcccaagtgtactttacttcctttcattcctgccctaaagctttttaataaaccttcactcctgctctaaaacttgcctcagtctctccctctgcctcgtgcccctcggtcaaattctttcctctgaggacgcaagaattgaggttgctacagacctgtacagattcgcc

SEQ ID NO: 758 - DNA, 795 bp, Homo sapiens
gagagacacgactagctggatttcctaggccgactaaggaatccccaagcctagctgggaaagtgaccgcttccacctttaaacatgggacttgcaacttagctcacacccgaccaatcagatagtaaggagagctcactaaaatgctaattaggcaaaaacaggaggtaaagaaatagccatctgctgcctgagagcacagcaggagggacaatgatcaggatataaacccaggcattcgagccagcaatggcaaccccctttgggtcccctccctttgtacgggagctctgttttcactgtgtttcactctattaaatcttgcaactgcactcttctggtccatgtttgttacagctcgagctgagctttcgcttgccgtccaccactgcccaccactgtcgtttgctgccatcgcagacctgctgctgacttccatccctctggatccggcaaggtgtgtgctgtgctcctgatccagcaaggtgcccattgccagtcccgattgggctaaaggcttgccattgttcctgcacggctaagtgcctgggttcatcctaatcgagctgaacactagtcactgggttctacggttctcttccatgacccacggcttctaatagagctataacactcaccacatggcctaagattccattccttggaatccgtgaggccaagaaccccaggtcagagaacacgaggcttgccaccatcttggaagcgacccaccaccatcttggaagtggctcgccaccatcttgggagctctgtgagcaaggacccctggtaaca

SEQ ID NO: 759 - DNA, 750 bp, Homo sapiens
gagagactggactagctggatttcctaggccgactaagaatccctaagcctagctgggaaggtgaccgcttccacctttaaacacagggcttacaacttagctcacatgggaccaatcagatagtaaggagagctcactaaaatgctaattaggcaacaacaggaggtaaagaaatagccaatcatctgttgcctgagagcacagcgggagggacgatgatcaggatataaacccaggcactggagccggcaatggcaaccccctttgggtcccctccctttgtatgggagctctgttttcacgctatttcactctattaaatcttgcaactgcactcttctggtccatgtttgttacggctcgagctgagctttcgctcaccatccaccactgctgtttgccactgactcccatccctccggatctggcagggtgtcctctgtgctcctgatccagcgagactcccgttgccactcccaatcgtgctaaaggcttgccattgttcctgcacagctaagtgccttggttcatcctaatcgagctgaacactagtcactgggttccacggttctcttccgtgacccacggcttctactagagctataacactcaccgcatggcccaagattccattccttggaatccgtgaggccaagaaaggcttgccaccatcttggaagtggcctgccaccatcttggaagtagctcgccaccatcttgggagctctgtgagcaaggacccctggtaa

SEQ ID NO: 760 - DNA, 2158 bp, Homo sapiens
tgcagtcagaattcttacacaagagccagaaccacaccctgtagcctttctgtccaaacaacttgaccttactgttttagcctagccatcatgtctccgtgcagcagctgctgccgccctaataattttagaggccctcaaaatcacaaactatgctcaacttactctctacatttctcataacttccaaaatctattttcttcctcatacctgatgcatatactttctgctccccggctccttcagctgtactcactctttgttaagtcccacaattaccattgttcctggcccggacttcaatccggcctcccacattattcctgataccacacctggcccctatgaatgtatctctctgatccacctgacattcaccccatttccccatattgccttccttcctgttcctcaccctgatcacacttgatttattgatggcggttccaccaggcctaatcgccacacaccagcaaaggcaggctatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagctcaaggatttgcccccgcccaggactggcaaattagctttactcaacatgccccgagtcacaaaaactaaaatacctcttagtctaagtagacactttcactagataggtagaggcctttcccacagggtctgagaaggccaccgcagttatttcttcccttctgtcagatataattcctcagtttagccttcccacctctatacagtctgataacagatcagcctttattagtcaaatcagccaagcagtttttcatgctcttagtattcagtgaaacctttatatcccttacagtcctcagtcttcaggaaaagtagagcagactaaaggtcttttaaaaacacacctcgccaagctcagccacacacttaaaaaggaatagacaatacttttaccactttcccttctcagaagtcagacctgtcctcagaatgctacaaggtacagcccatttgagctcctgtatagacgttcctttttattaggccctagtctcattccagacaccagaccaacttagtctgtgccccaaaaaaacttgtcatccctactatcttctgtctagtcatactcctattcactgttctcaactactcatacatgccctgctcttgtttacactgccggtttacactgtttctccaagccatcacagctgatatctcctggtgctatccccaaactgccactcttaactcttgaagtaaataaataatctttgctggcaggactatgctgaatctccttaagcactctctaatcagatgtcctgagtcgtcccaattcttagaccttttatacctgtttttctccttctcttattccatttagtttttcaattcatacaaaactgtatccaggccatcaccaataattctaaattacaaatgttccttctaacaaccccacaatatcaccccttaccacaaaatcttccttcagcttaatctctcccactctagcttcccacaccgcccctaatcccgctcgaagcagccctgagaaacatcgcccattatctctccataccatcccccaaaattttcgctgtctcaacactttaccactatttcgttttatttttcttattaatataagaagacaggaatgtcaggcctctgagcccaagctgagccatcatatcccctgtgacctgcacgtacacatccagatcgctggttcctgccttaactgatgacattccaccacaaaagaagtgaaaatggcctgtttctgccttaactgatgacatcgtcttgtgaaattccttctcctggctcatcctggctcaaaagctcccccactgagtaccttgtgacccccactcctgcccgccagagaacaacccccctttttcctttacctacccaaatcctataaaacggccccacccctatctcccttcgctgactctcttttcggactcagcccacctgcacccaggtgaaataaacagctttattgctcacacaaagcctgtttggtggtctcttcacacagacgcgcgtgaaa

SEQ ID NO: 761 - DNA, 985 bp, Homo sapiens
gtggggaaaagaaagagagatcagattgttactgtgtctgtgtagaaagaagtagacataggagactccattttcctctgtactaagaaaaattcttctgccttgagatgctgttaatctgtaaccttacccccaaccctgcgctccctgaaacatgtgctgtgtcaactctgggttaaatggattaagggctgtgcaagatgtgctttgttaaacaaatgcttgaaggcagcatgctcgttaagagtcaccaccactccctagtctcaaaccactccctaatctcaagtacccagagacacaaaacactgcggaagcccgcagggacctctgcctaggaaagccaggtattgtccaaggtttctccccatgtgatagtctgaaatatggcctcatgggaagggaaagacctgaccgtcccccagcccgacacccgtaaagggtctgtgctgaggaggattagtaaaggaggaaggaacgcctttttgcagttgagacaagaggaaggcatctgtctcctgctcgtccctgggcaatggaatgtctcggtgtaaaacccgattgtatattccatctactgagacaggggaaaaccgccttagggctagaggtgggacatgtgggcagcaatactgctgtttaaggcattgagatgtttatgttatacatatctaaagcacagcacttaattctttaccttgtttatgatgcagagacctttgttcacgtgtttacctgctgaccttctctccactattatcctatgaccttgccacatgcccctctctgagaaacacccaataatgatcaataaatactaagggaactcagaggccggcaggatcctccgtatgctgaacgccggtcccccgggcccccttttttctttctctatactttgtctctgtgtctctttcttttgcaagtctctcgttccacctaaggagaaaaacccacaggtgtggaggtgcaacccaccccttca

SEQ ID NO: 762 - DNA, 441 bp, Homo sapiens
gtcaggcctctgagcccaagctaagccatcgcatcccctgtgacctgcacgtatatgcccagatggcctgaagtaactgaagaatcacaaaagaagtgaaaatggcctgttcctgccttaactgatgatattccaccacaaaagaagtgaaaatggccagtccttgccttaagtgatgacattaccttgtgaaattccttttcctgactcaaaaactcccccactgagcatcttgtgatccccactcctgcccaccagagaacaacccccctttgactataattttcctttacctacccaaatcttataaaatagccccacccctatctccgttcactgactctctttttggactcagccagcctgcacccaggtgattaaaaagctttattgctcacacaaagcctgtttcatggtctcttcacacggacgcgagtgaaa

SEQ ID NO: 763 - DNA, 421 bp, Homo sapiens
gtcaggcctttgagcccaagctaagccatcatataccctgtgacctgcacgtatacatccagatggcctgaagcaactgaagatccacaaaagaagtgaaaatagccttaactgatgacattccaccattgtgatttgtttcttccccaccctaactgatcaatgtactttgtaatctcccccacccttaagaagtttctttgtaattctccccacccttgagaatgtattttgtgagatccaccccctgcccccaaaacattgctcttaactccactgcctatcccaaaacctataagtactaatgataatctcaccatcatttgctgactctctttttggactcagcccgcctgcaaggtgaaataaacagccttgttgctcacacaaagcctgtttggtggtctctacacacggacac

SEQ ID NO: 764 - DNA, 5535 bp, Homo sapiens
aactgaagatccacaaaagaagtaaaaacagccttaactgatgacattccaccattgtgatttgttcctgccccaccctaactgatcaatgtactttgtaatctcccccacccttaagaaggttctttgtaattctccccacccttgagaatatactttgtgagatccacccctgcccaccagaggacaaccccctttgactgtaattttccattaccttcccaaatcctataaaacggccccacccgtatctcccttcgctgactctcttattggactcagcccacctgcacccaggtgaaataaacagccatgttgctcacacaaagcctgtttggtggtctcttcacacagacgcgcatgaaatttggtgccgtgactcggatcgggggacctcccttgggagatcaatcccctgtcctgctgctctttgctccgtgagaaagatccacctatgacctcaggtcctcagaccgaccagcccaagaaacatcgcaccaatttcaaatccggtaagcggcctctttttactctcttctccaacttccctcactatccctcaacctctttctcctttcaatcttggcgctacgcttcaatctctcccttctcttaatttcaattcctttcattttctggtagacacaaaagagacgttttatccgtggacccaaaactccggcgccggtcacggactgggaaggcagccttcccttggtgtttaatcaatgcagggacgcctctctgattatacacccacgtttcaagggtgtcagaccacgcagggacacctgccttggtccttcacccttagcggcaagtcctgcttttctggggaaggggcaagtagcccaaccccttctctccttgtctctaccccttctctgctttcctggggcaggggcaagtacccctcaaccccttctccttcacccttagcggcaagtcccgctttcctggggcaggggcaagtacccctcaaccccttctccttcacccttagcggcaagtcctgcttttctagggggcaagaacccccaaaccacttccctccgtgtctctacgctctctgttctctgggcttgcctccttcactatgggcaagcttccaccttccattcctccttcttctcccttagcctgtgttcttaagaacttaaaacctcttcaactctcacctgacctaaaatctaagcatcttattttcttctgcaatgccgcttgaccccaatacaaactcgacagtagttccaaatagccagaaaacagcactttcaatttttctgtcctacaagatctaaataattcctgtcgtaaaatgggcaaattgtctgaggtgcctgacgtccaggcattcttttacacatcagtccattcctagtctctgtgcccaatgcaactcgtcccaaatctcccgcctgtcccctcagtcccaacgccaagcatcgctgagtctttctaatcttccttttctacagacccatctgacctctcccctcctagccaggccaagctaggtcccaattcttcctcagcctccactcctccaccctataatctttttatcgcttcccctcctcacacctggtcgggcttacagtttcattccgtgactagccctcccccacctgcccagcaatttattcttaaaaaggtggctggagctaaaggcatagtcaaggttaatgctcctttttatttatcccaaatcagatagcgtttaggctttttcatcaaatataaaaaccctgcccagttcatggctcgttcggcagcaaccctgagactctttacagccctagaccctgaaaggtcaaaaggccatcttattctcaatatacattgtattacccaatctgctcccgacattaaataaaactccaaaaattaaattctggccctcaaaccccacaacaggatttaattaacctcgccttcaaggtgtacaataatagaaaaaagttgcaattccttgcctccactgtgagacaaaccccagccacatctccagcacacaagaacttccaaacgcctgaaccacagcagccaggcttcctccagaacctcctcccccaggagcttgctacaagtgccagaaatctgaccaccaggccaaggaatgcctgcagcccaggattcctcctaagccatgtcccatctgtgcgggaccccactggaaactggactgttcaactcacctggcagccactcccagagcccctggaactctggcccaaggctctctgactgactccttctcggcttagcggctgaagactgatgctgcccgatcgcctcggaagccccgtagaccatcacggacaccgagctttgggtaactctcacagtggaaggtaagtccgtccccttcttaatcaatatggaggctacccactccacattaccttcttttcaagggcccgtttccgttgcctccataactgttgtgggtattgacggccaggcttctaaacctcttaaaactccccaactctggtgccaacttagacaatactcttttaagcactcctttttagttatccccacctgcccagttcccttattaggctgagacactttaactaaattatctgcttccctgactattcctggactacagctacatctcattgccgcccttcttcccaatccaaagcctcctttgtgtcctcctcttatatccccctaccttaacccacaagtataagatacctctactccctccttggcgaccgatcatgcaccccttaccatctcattaaaacctaatcacccttaccccgctcaatgtcaagatcccatcccacagcacgctttaaaaggattaaagcctgttatcactcgcctgctacagcatgaccttttaaagcctataaactctccttaccattcccctgttttacctgtcctaaaaccagacaaggcttacaagttagttcagaatctgcgccttatcaaccaaattgttttgcctatccaactcgtggtgccaaatccatatactctcctatcctcaatacctctctctactacccattattctgttctagatctcaaacatgctttctttactattcctttgcacgcttcatcccagcctctctttgctttcacttagactgaccctgacacccatcaagctcagcaaattaccttggctgtactgccgcaaggcttcacagacagcccccattacttcagtcaagcccaaatttcaccctcatctgttacctatctcggccaaattctcataaaaacacacgtgctttccctgctgatcgtgtctgattaatctcccaaacctcaatccctttcaaaacaacaactcctttccttcctaggcatggttagtgcggtcagaattcttacacaagagccaggaccgcaccctgtagcctttctgtccaaacaacttgaccttactgttttagcctagccctcatgtctgcgtgcagcggctgccgctgctttaatacttttagaggccctcaaaatcacaaactatgctcaactcactctctacatttctcataacttccaaaatctattttcttcctcatacctgatgcatatactttctgcttcccggctccttcagctgtactcactctttaagtcccacaattaccattgtttctggcccggacttcaatccggcctcccacattattcctgataccacacctgacacccatgactgtatctctctgatccacctgatattcaccccatttccccatatttccctctttcctgttcctcaccctgatcacgcttgatttattgatggcagttccaccaggcctaatcgccgcataccagcaaaggcaggttatgctatagtacaagccactagcccacctctcagaacctctcatttcctttccatcgtggaaacctgtcctcaaggaaataacttctcagtgttccatctgctattctactactcctcagggattattcaggccccctcccttccctacacatcaagttcgaggatttgcccctacccaggactggcaaattagctttactcaacgtgcctgagtcaggaaactaaaatacctcttagtccaaatagacactttcactgaataagtaaaggtctttcctacagggtctgagaaggccaccgcagtcatttctttccttctgtcagacataattcctcagtttagccttcccacctctatacagtctgataacggaccagcctttattagtcaaatcagccaagcagtttttcaggctcttagtaggtttcagtgaaaactttatatcccttacggtcctccgtcttcaagaaaagtagaacggactaaagatcttttaaaaacacagctcaccaagctcagccaccaacttaaaaggactgacaatacttttaccacttttgcttctcagaattcaggcctgtcctcaatgctacaaggtacagcccatttaagctcctgtatagacgctcctttttattaggccccagtctcatttgacaccagaccaacttagactgtgccccaaaaaaacttgtcatccctactatcttttgtccagtcatactcctattcaccgttctcaactactcatacatgccctgctcttgtttacactgccggtttacactgtttctccaagccatcacagctgatatctcctggtgctatccccaaactgccactctaaactcttgaagtaaataaataatctttgctggcaggactatgctgaatctccttaggcactctctaatcagatgtcctaggtcctcccaattcttagaccttttatacctgtttttctccttctcttattccatttagtttctcaattcatccaaaaccgtatccaggccatcaccaatcattctatacaacaaatgtttcttcttacatccccacaatatcaccctttaccacaagacctcccttcagcttaatctctcccactctaggttcccacgccgcccctaatcctgcttgaagcagccctaagaaacattgcccattctctctccataccacccccacaaaaattttcgccgccccaacacttcaacactattttgttttgtcttattaatataagaaggcaggaatgtcaggcctctgagcccaggccaggccatcgcatcccctgtgacttgcacgtatacatccagatggcctaaagtaactgaagatccacaaaagaagtaaaaacagccttaactgatgacattccaccgtgtgatttgttcctgccccaccctaactgatcaatgtactttgtaatctcccccacccttaagaaggttctttgtaattctccccacccttgagaatgtactttgtgagatccacccctgcccaccagagaacaaccccctttgactgtaattttccattaccttcccaaatcctataaaacggccccacccatatctcccttcgctgactctcttttcggactcagcccacctgcacccaggtgaaataaacagccatgttgctcacacaaagcctgtttggtggtctcttcacacggacatgtatgaaa

SEQ ID NO: 765 - DNA, 718 bp, Homo sapiens
ttagagtaggtagctaggcagacatgagcagggcaggagagggcccccctcccccaggaatgtcaggtgaccatcaagtaatggtcaggcaattgttaagctgtctctctaaaataactggttgcagccagagccagagaaagagtctcccaatagatagaaaacatctgaagctggtaatcagcagcttcctgacaagatctcaggagttgggcgagtgggctcaagcacgcacactaagaggcaaaatggcagtttaaccggtatgtgaccttcctctagaaacgactgataagggaaaaacacctcaaatgagcatgcatacacctccagtaaacagtctgagcatgcagctcctcccaagtgctggcaagccaccatgcctgcggacagcctgctccaagggaagagtcgggggagaagaaacataaaccctggaaccatgccaatgtataaaacctcaagtcaagggccggatggggcacttggatctctcaggtcacctgcttggctctcttccaagtatactttacttccatttgttcctgctctaaaactttttaataaaccttcactcctgctctaaaacttgcctcagtctctccctctgccttaagcctacttctgcccctcggccaaattctttcctccaaggaggcaagacttgagttgctgcagacccatatggatttgctgctgctaacatactttggtgcca

SEQ ID NO: 766 - DNA, 5617 bp, Homo sapiens
gtcaggcctctgagcccaagctaagccatcatatcccctgtgacctgcatgtacacatccagatggccggttcctgccttaactgatgacattccaccacaaaagaagtgcaaatggcctgttcctgccttaactgatgacattgtcttgtgaaattccttctcctggctcatcctggctcaaaagctcccctactgagcatcttgtgacccccgactctgcccgccagagaacaacccccctttgtaattttcctttacctacccaaatcctataaaacggccccaccccatctcccttccctgactctcttttcggactcagcccgcctgcacccaggtgaaataaacagccatgttgctcacacaaagcctgtttggtggtctcttcacacagacgtgtatgaaatttggtgccgtgacttggattgggggacctcccttgggagatcaatcccccgtcctcctgctctttgctctgtgagaaagatccacctatgcctcaggtcctcagactgaccagcccaagaaacatctcaccaatttcaaatcgggtaagccccctcttcttactctcttctgcaacctctctcactgtttctcagcctctttctcctttccactcttcaatctctcccttcttttaatttcaattcctttcattttctggtagagacaaaggagacacattttattggtggacccagaactccggcgctggtcattgactgggaaggcagccttcccttggtgtttaattattgcagggatgcctctttgattattcacccaggtttcagaggtgtcagaccacgcagggacgcctgccttggtccttcacccttagtggcaagtcccacttttctggggaaggggcaagtaccccaaccccttctctccgtgtctctaccccttctccacctttctggggggcaagaaacccccaaccccttctccttcacccttagtgacaagtcccgcttttctgggggaggagcaaataccccaaccttgtatctctgcaccccaatcccttatttccatgccccgacctcttatctcggtgccccaaccccttatttccacaccccaacccctttcccgcttttgtggagggcaagaaccccccaccccttctccgtgtctctattcttttctctgggcttgcctccctcactatgggcaagcttccaccttccattcctccttcttctcccttagcctgtgttcttaagaacttaaaacctcttcaactatcacctgacctaaaatcttaagtgtcttattttcttctgcaatgccacttgaccccaatacaaactcgatagtagttccaaatagccagaaaatggcactttcaatttttccatcctacaagatctaaataattcttgtcataaaatgggcaaatggtctgaggtgcctgacgtccaggcattcttttacacatcggtcccttcctagtctctgtgcccaatgcaactcgtcccaaatcttccttctttccctcccacctgtcccctcagtcccaatcccaagcgtcactgagtctttctaatcttccttttctacagacctatctgacctctcccctcctggccaggccgagctaggtcccaattcttcctcagcctcagctcctccaccctataatccttttatcacctcccctcctcacacccagtcaggcttacagtttccttccatgactagccctcccccacctgcccagcaatttactcttaaaaaggtggctggagctaaaggcatagtcaaggttaatgctcctttttctttatcccaaatcagatagcatttaggctctttttcatcaaatataaaaatccagcccagttcatgacttgtttggcagcaaccctgagacactttacagctctagaccctaaaatgtcaaaaggccgtcttattctcaaaatacattttattacccaatctgctcccgacattaaataaaactccaaaaattaaattccggccctcaaaccccacaacaggatttaattagcctcaccttcaaggtgtacaataatagaaaacagttgcaattccttgcctccactgtgagacaaaccccagccacatctccagcacacaagaacttccaaacacctgaaccgcagcagccaggcattcctccagaacctcctcccccagtagcttgctacaagtgccagaaatctggccaccaggccaaggaatacctgcagcccaggattcctcctaagccacgtcccatctgtgcgggaccccactggaaatcggactgtccaactcacctggcagccactcccagagcccctggaactctggcccaaggctctgactccttcctgggtcttcttggcttagcagctgaagactgatggtggctgatggcctcggaagccccctagaccatcacggatgccaagcttccagtaactctcacagtggagggtaagtctgtccccttcttaatcaatacggaggctacccactccacattaccttcttttcaagggcctgtttcccttgcctccataactgttgtggttactgacggccaggcttctaaacctcttaaaactccccaactctggtgccaacttggacaacactcttttatgcactcttttttagttatccccacctgcccagttcccttattaggccgagacactttaaccaaattatctgcttccctgactattcctggactacagctgcatctcattgccacccttctccccaacccaaagcctccttcgcgtcttcctctcgtatccccccaccttaacacacaagtatgggacatctctactccttccctggcaaggatcacatgcccattaccatcccattaaaacctaatcacccttaccccgctcaatgccaatatcccatcccacagcacgctttaaaaggattaaagcccgttatcactcgcctgctacagcatgggcttctaaaacctataaactctccttacaattcccccattttacctgtccaaaaactggacaagtcttacagattagttcaggatctgcgccttatcaaccaaattgttttgcctatccatcctgtggtgcccaacccgtacactcttttgtcctcaataccttcctccacaactcactattccgttctcgatcttaaagatgcttttttcactattcccctgcacccctcatcccagcctctctttgctttcacttagactgaccctgacacccatcaggctcagcaaattacctgggctgtactgccgcaaggcttcacagacagcccccattacttcagtcaagccgaaatttcatcctcatctgttacctatctcggcataattctcataaaaacacacgtgctttccctgctgatcatgtccgattaatctcccaaacctcaatcccttacaaaacaacaactcctttccttcctaggcatggttagtgcagtcagaattcttacacaagagccaagactgcaccctgtagcctttctgtccaaacaacttgaccttactgttttagcctagccttcgtgtctccgtgcagcagctgctgccactctaatactttcagaggccctcaaaatcacaaactatgctcaactcactctctacatttctcataacttccaaaatctattttcttcctcatacctgacacatatactttctgttccctggctccttcagctgtactcactctttgttaagtcccacaattaccattgttcctggcccagacttcagtccggcctcccacattattctggataccacacctgaccctcatgactgtatctctctgatccacctgacattcaccccatttccgcatatttccttctttcctgctcctcaccctgatcacgcttgatttattaatggcagttccaccaggcctaatcgccacacaccagcaaaggcaggctatgctatagtacaagtcactagcccgcctcttaaaacctctcatttcctttccatcgtggaaatctatcctcaaggaaataacttctcagtgttccatctgctattctactactcctcaaggattattcaggcccccctcccttccctacacatcaagctcgaggatttgcccccacccaggacttgcaaattagctttactcaacatgccccgagtcagataactaaaatacctcttagtctaggtagacactttcactggataggtagagtcctttcctacagggtctgagaaggccactgcagtcatttcttcccttctgtcagacataattcctcagtttagccttcccacctctatacagtctgatagcagaccagcctttattagtcaaatcagccaagcattttttcaggctcttagtattcagtgaaacctttatatcccttacagtcctcagtcttcaggaaaagtagaacagactaatggtcttttaaaaacacacctcaccaagctcagccaccaacttaaaaaggactagacaatacttttaccactttcccttctcagaagtcagacctgtcctcagaatgctacagtgtacagcccatttgaggtcctgtatagatgctcctttttattaggccccagtctcattccagacaccagactaacttagactgtgccccaaaaaaacttgtcatctctactatcttctgtctagtcatactcctattcaccgttctgaactactcatacatgctctgctcttgtttacactgccagtttacactgtttctccaagccatcacagctgatgtctcctggtgctatccccaaactgccactcttaactcttgaagtaaataaataatctttgctggcaggactatgctgaatttccttaggcactctctaattagatgtcctacgtcctcccaattcttagacctttaatagctgtttttctccttctcttattccgtttagtttttcaattcatacaaaactgtatccaggccattaccaataattctaaatgacaaatatttcttctaacagtcccacaatatcaccccttaccacaaaatcttccttcagcttaatctctcccactctaggttcccatgctgcccctaatcccactcaaagcaccctgagaaacatcgcccattgtctctccataccacccccaaaaattttcaccgccccaacactttaccactatttcattttatttttcttattaatataagaagacaggaatgtcaggcctcggagcccaagctaagccatcatatcccctgtgacctgcatgtacacatccagatggccggttcctgccttaactgatgacattccaccacaaaagaagtgaaaatggcctgttcctgccttaactgatgacattgtcttgtgaaattccttctcctggctcatcctggctcaaaagctcccctactgagcaccttgtgacccccactctgcccgccagagaacaacccccctttgactgtaattttcctttacctacccaaatcctataaaacggccccaccccatctcccttcactgactctcttttcggactcagcccgcctgcacccaggtgaaataaacagccatgttgctcacacaaagcctgtttggtggtctcttcacacggacgcgcatgaaa

SEQ ID NO: 767 - DNA, 5995 bp, Homo sapiens
gtcagggctctgagcacaagctaagccatcgtatcccatgtgacctggaagtatatatccagatggcctaaagtaactgaagaatcacaaaagaagtgaaaatagtctggtcctgccttaactgatgatattaccttgtgaaattccttctcctggctcatcctggctcaaaagctcccccactgagcaccttgtgacccccacccctgccagccataaaacaaccccctttgactgtaattttccactacctacctaaatcctataaaacggccccacccctatctcccttccctgactctcttttcggattcagcccgcctgcacccaggtgaaataaacagccttgttgctcacacaaagcctgtttggtggtctcttcatacagacgcgagtgaaatttggtgccgtgactcggattgggggaccacccttgggagatcaatcccctgtcctcctgctctttgctccatgagaaagatccacctatgacctcggatcctcagaccaaccagcccaaggaacatctcaccaattttaaatccggtaagtgacctctctttactctcttctctaacttctctcactatccctcaacctctttctcctttcaatcttggtgccacacttcaatctctcccttctgttaatttcagttcctttcctttcctggtagagacaaaggagatgcattttatccgtggacgcaaaactccagcaccggtcacagactcgggaagacagtcttcccttggtgtttaatcactgcagggacgcctgcctgattattcacccacatttcattggtatctgatcaccgcagggacgcctgccttggtcattcactcacattcccttggtggcaagtcaattgcagggacgcctgctttggctgctcacccacattgcagcccagggctgctcaccccacccattctctccatgcctctactctctcttttctctccactttcctggggggcaagcacctcccaccccttttccactttcctgggggacaagcacctcccaccccttctctctgtgtctctaccctctcttttctctgaactcgcctccttcactataggcaaccttccaccctccattcctccttcttctcccttagcctgtgttctcaagaacttaaaacctcttcgactcacacctgacctaaaacctaaatgccttattttcttctgcaacaccgcttgaccccaatacaaaatcgacaatggttccaaatagccggaaaacagcactttctatctctccatcctataagatctggataattcttggtgtaaaatgggcaaatggtctgaggtgcctgatgtccaggcattgttttacacattggtccctccctggtctctgttcccaatgcaacttgtcccaaatcttccttctttccctcccacctgtcccctcagtcccgaccccaagtgttgctgagtctttccaatcttccttttttatggacccatctgacctctcccctcctccccaggctgctcctcgccaggccaagccaggtcccaattcttcctcggcctccgctccccaaccctataatccttttatcacctcccctcctcacacccagtcccgcttatagttttgttctgccactagccctcccctacctgcccagcaatttcctcttaaaaaggtggctggagctgaaggcatagtcaaggtgaatgctcctttttctttatccggcctctcccaaatcagttagcgcttaggctctttttatcaaatataaatacccagcccagttcatggcttgtttggcagcaatcctgagacgctttacagccctagaccctaaaaggtcaaaagcccatcttatcctcaaaatacattttattacccaatctgctcccgacattaaataaaactccaaaaattaaattccagccctcaaaccccacaacatgacttaattaaccttgccttcagggtgtacaataatagagaagagttgcaattacttgcctctgctgtgagagaaaccccagccacatctccagcacacaaggacttcaaaacgcctaagccacagcggccaggcattccttcaggacttcctcccccaggatcttgcttcaagtgctggaaatctggccaccgggccaaggaatgcccgcagcccaggattcctcctaagccgtgtcccatctgtgtgggaccccagtggaaactggactgtccaactggcctaaggctctgactagctccttcccagatcttcttggcttagcggctgaagactgacgctgcccaatcaccttagaagcttcctggaccatcacagaagctctaggtaactcttacagtggagggtaagtctgtccccttcttaatcaatacagaggctacgtactccacattaccttcttttcaagggcccgtttcccttgcctccataactgttgtgggtattggcagccaggcttctaaaccccttaagactcccccactctggtgctaacttggacaacattcttttatgcattcttttttagttatccctacctgcccagttctcttattaggctgagacattttaactgaattatctgcttccctgactattcctggactacagccacatctcattgccacccttcttcccaacccaaagcctccttcatgccttcttctcatatccccccaccttaacccacaagtatgggacacctctactccctccctggcaactgatcaccagcccattatcccattaaaacctaatcaaccttaccctgctcaacactagtatcccatcccacaacaggctttaaagggactgaagcctgtgatgactcacctgctacagcatgggcttctaaaacctataaactctccttacaattcccccattttacctgtccaaaaaccagacaagccttacaggttagttcaggatccgcaccttatcaaccaaattgttttgcctatcccccccatggtgccaaacccatatactctcctatcctcaatacctccctccacaacccgttattctgttctggatctcaaacatgctttctttactattcctttgcacccttcatcccagtctttcttcgctttcacttggactgaccctgacacccatcaggctcagcaaattacctgggctgtactcccgcaaggcttcacagacagcccccattacttcagtcaagcccaaatttcttcctcatgtgttacctatctcgacatagttctcataaaaacacacgtgctctccctgctgatcgtgtccagctaatctcccaaaccctgaccccttctacaaaatgacaactcctttccttcctaggcatggttaggtacttccacctttggatacctcgtttttccatcctgactaaaccattatataaactcacaaaagcaaacctggctgaccccacagatcccaaatcctttcgccactcctttccattccttaaaaacagccctagaagctgctcccacactagctctccctaactcatcccaaccctttttcattaacacagctgaagtgcagggctgtgcagtcaaaattcttacacaaggactgggaccatgccctgtggcctctttatccaaacaacttgactttactgttttagcctagtcctcatgtctgtgtgcggtggctgccgctgccttaatacttttagaggtcctaaaaatcacaaactatgctcaactctctacagtcactctctacagttctcataacttccaaaatctattttcttcctcacacctgacacatatactttctgctcccctccactacctctcagcaagccaaactcatttccttaactcaagccctactcttgcaaaaggactacttgtcaatatttatactgactctaactatgccttccatatcctgccccaccatgctgttatatgggcagaaagaaatttcttcactacacaagggtcctccatcattaatgcctctttaataaaaactcttctcaaagccgctttacttccaaaggaagctggagtcattcactgcaagggccatcaaaaggcatcagatcccattgctcagggcaacgcttatgctgataaggtagctaaagaagcagctagcgttccaacttctctccctcatggcagtttttctccttctcatcggtcactcccacttactcccctactgaaacttccacctatcaatctcttcccacacaaggcaaatggttcttggaccaaggaacatatctccttccagcctcacaggcccattctattctgtcgtcatttcataacctcttccatgtaggttataagctgctagtctgcctcttagaacctctcatttcctttccatcgtggaaatctatcctcaaggaaatcacttctcagtgttccatctgctgttctactactcctcagggattgttcagggcccctcccttccctacacatcaagctcggggatttgcccttgcccaggactggcaaattgactttactcacatgccctgagtcaggaaactaaaatacgtctcggtctagatagacactttcactggatgggtagaggcctttcccacagggtctgagaaggccaccgcagtcatttcttcccttctgtcagacataattcctcagtttggccttcctacctctataccgtccaataacggaccggcctttattagtcaaatcacccaagcagtttctcaggctcttggtattcagtggaaccttcataccccttaccatcctcaatcttcaggaaaggtagaatggaacagactaatggtcttttaaaaacacacctccccgagctcagccaccaacttaaaaaggactagacaatacttttaccactttcccttctcaaaattcgggcgtgtccttggaatgctacagggtacagcccatttgagctcctatatagacactcctttttattaggccccagtcttattccagacagcagcccaacttggactgtgccccaaaaacttgttatctgtactatcttctgcctagtcatactcttattcactgttctcaactactcataaatgccctgctcttgtttacactgccggtttacactgtttctccaggccatcacagctgatatctcctggtgctatccccaaaccaccactcttaactccctcttaaagtaaatcaataatctttgctggcagggctatgctgaacctccttgggcactctctaattggatgtcctgtgtcctcccaattcgtagtcctttaataccagtttttctccttctcttattcggaccttgtgtcttccgcttagtttttcaattcatacaaaacaacatccaggccatcaccaattattctatatgacaaatgctccttctaacaaccctgcaatatcaccccttaccacgaaatcttccttcagctgaatctctcccactctgggttcccacgccacccctaatcccgcttgaagcagccctgagaaacatcgcccattatctctccatgccacccccccaaaattttcactgccccaacacttcaatactattttatgttatttttcttattaatataagaaggcaggaatgtcaggcctctgagcccaagctaagccatcgtatcccctgtgacctgcacatatacatccagatggcctgaagtaactgaagaatcacaaaagaagtgaaaatggcctgttcctgccttaactgatgacattaccttgtgaaattccttctcctggctcatcctggttcaaaagctccccaactcagcaccttgtgacctccacccctgccagccataaaacaaccccctttgactgtaattttccactacctacccaaatcctataaaatggccccacccctatctcccttccctgacactgttttcggactcagcccgcctgcacccaggtgaaataaacagccttgttgctcacacaaagcctgtttggtggtctcttcacagggacgtgcgtgaaa

SEQ ID NO: 768 - DNA, 6332 bp, Homo sapiens
gtcaggcctcggagcccaagctaagccatcatatcccctatgacctgcatgtatacatccagatggcctgaagtaactgaagaatcacaaaagaagtgaaaatggcctgttcctgccttaactgatgacattaccttgtgaaattccttctcctggctcatcctggctcaaaagctttcccactgagcaccttgtgtcccccacccctgccagccagagaacaaccccctttgactgtaattttcctttaccttcccaaatcctataaaatggtcccaccccatctccctttgctgactctcttttcagactcagcccgcctgcacccaggtgaaataaacagccttgttgctcacacaaaacccgtttggtggtctcttcacacggacgcgaatgaaatttggtgctgtgactcggatcgggggatctcccttgggagataaatcccatgtcctcctgctctttgctctgtgagaaggatccacttatgacctcaggtcctcagaccaaccagcccacagaacatctcaccaattttaaatcgggtaagcggcctctttttactctcttctccaacctctctcactatccctcaacctctttctccttcagtctttcccttctcttaatttcagttccttcaatcacactttggtctctcccttctcttaatttcagttcctctccttttctggtagagacaggagatgcgttttatccgtgaacccaaaactccggcgctggtcacggactcgggaagacagtcttcccttggtgtttaatcatgtggggttgcctgcttgattattcacccacatttcagaggtgtctgaccacacagggatgcctgccttggtccttcagccttagcggcaagcactgcttttctggggggcaagcacccccccaccccttctctccatgtctctatcccttttccactttcctggagggcaagcatcccccacctcttctctccgtgtctttaccccttttccacttttctggggggcaagcacccccccactccttctctctctgtctctaccccttttccactttcctggggggcaagcacctcccaccccttttctgctttcctaagggcaagcgccccccaccccttctctccatgtccctatcctctcttttctctggacttgcctccttcactataggcaaccttccacactccattcctccttcttctcccttagcctgtgttctcaagaacttcaaacctcttcaactcacacctgacctaaaacctaaatgccttattttcttctgcaacaccgcttgaccccaatacaaacttgacagtggttccaaataaccagaaaacagcactttcgatttttccatcctacaagatctaaataattcttgtcataaaatgggcaaacggtctgaggtgcctgatatccaggcattcttttacacatcggtccctccctagtctctgtttctaatgcaactcgtcccaaatcttgcttctttccctcccgcctgtcccctcagtcctaaccccaagcgtcaatgagtctttccaatcttccttttctacagacccatctgacctctcccctcctccccaggctgctcctcgccaggctgagctaggtcccaattcttcctcagcctccactcccccaccctgtaatccttttatcacctcctctcctcacacccagtccagcttacagttttgttctgcaactagccctccccaacctgcccagaaatttcctcttagaaaggtggctggagctaaaggcatagtcaaggttaatgctcctttcctttatctgacctttcccaaatcggttagtgtttaggctctttttcatcaaatataaaaacccagcccagttcatggcctgtttggcagcaacccttagactctttacagccctagacactgaagggtcagaaggctgtttcattctaaatatgcattttatcacccagtcagctcctgtcattagaaataaagctccaagaattaaattccggccctcaaaccccaaaacaggacttaattaacctcaccttcaaggtgtacaataatagagtagaggcagccaagtagcaatgtatttctgagttgcaattccttgcctccactgtgagggaaaccccagccacatctccagcacacaaaaacttcaaaacgcctgaaccgcagcagccacgtgttcctccaggacctcctcccccaggagcttgctacaagtgctggaaatctggccactgggccaaggaatgcccacagcccgttattcctccttagccatgtcccatctgtgtgggaccccactgaaaatcggactcttcaactcacctggcagccactcccagagcccctggaactctggcccaaggctctctgactccttcccggatcttcttggcttagcggctgaagactgatgctgcccaatcaccttggaagccccctagaccatcatggatgccaagcttcgggtaactctcacagtggaaggtaagcccgtccccttcttaatcaacacggaggctacccactccacattaccttcttttcatgggcctatttcccttgcccccataactgttgtgggtattgatggccaggcttctaaacctcttaaactccccaactctggtgccaacttggacaacattcttttatgcactcttttttagttatccccacctgcccagttcccttattaggctgagacattttaactaaattatctgcttccctgactattcctaggctacagccacacctcattgctgccttttcccccagttcaaagcctccttcgtgtcttcctttcgtatctccccaccttaacccacaattataggatacctctactccctccatggcaaccgatctcaagcccttaccatcccattaaaacctaatcacccttaccccgctcaacgccaatatcccatcccatagcacactttaaaaggattaaagcctgttatcacttgcctgttacagcatggccttttaaagcctataaactctccttacaattcccccattttacctgtccaaaaaccggacaagccttacaggttagttcaggatgcacactttatcaaccaaattgttttgcctatccaccctgtagtgcccaacccttacactcttttgtcctcaataccttcctccacaactctctattctattcttgatcttaaagatgcttttttcactattcccctgcaccccttgtcccagcctctctttgcttttacctagactgatcctgacacctatcagtctcagcagcttacctgggctgtactgccacaaggctccagggacagccctcattacttcagccaagctctttctcatgatttactttctttccatccctccgctgctcaccttattcaatatattgatgaccttctactttgtagcccctcctttgaatcttctcaacaagacatcctcctgctctttcaacatttattctccaaaggatatcgggtatccttctccaaagctcaaatttcttctccatccgttacctaccttggcataattcttcataaaaacacacatgctctccctgctgatcgtgtctgactgatctctcaaaccctaacaccttctacaaaaccacaattcctttccttcctaggcatgattggatactttcacctttggatacctggttttgccatcctaacaaaaccattatataaactcacaaaaggaaacctagctgaccccataaatcctaaatcctttccccactcctcttttcattccttgaagatagctttagagactgcccccacgttagctctccctgactcatcccaacccttttcattacacacagccaaagtgcagggctgtgcagttggaattcttacacaaggaccaggaccatgccctatagcctttttgtccaaacaacttgaccttactgttttaggctggccatcatgtctctgtgcagtggctgccaccgccctaatacttttagaggccctcaaaatcacaaactatgctcaactcactctctacagttctcataacttccaaaatctattttcttcctcacacctgatgcatatactttctgctgcactacactacctctcagcaagccaaactcattgccttaactcaagtcctcacccttgcaaaggaattatgtgtcaatatttatactgactctaaatatgccttccatatcctgcaccaccatgctgttacatgagctgaaagagatttcctcactatgcaagggtcctccattattaatgcctctttaacaaaaactcttctcaaagctgctttacttccaaaggaggctggagtcattcactgcaagggccatcaaaaggcatcagatcccattgctcaggacaatgcgtatgttgataaggtagcttaaaaagcagccatcaaaaggcatcagatcccattgctcaggatgatgcttatgctgataaggtagctaaaaaagcagctagagttccaacttctatccctcatggcagtttttctccttttcatctggccactcccacctactccccaactgaaacttccacctatcaatcttttcccacacaaggcaaatggttcttggaccaagggtctccttccagcctcacaggcccattctattctgttgtcatttcataacctcttccatgtaggttacaagccgctagcccatctcttagaacctctcatttcctttccatcgtagaaatctatcctcaaggaaatcacttctcagtgttccatctgctattctactactcttcagggattactcaggcctacatatcaagctcggggccacccaggactggaaaattgactttactcacatgcctcagtgaggaaactaaaatacctcttggtctgggtagacactttcactgggtgggtagaggcctttcccacagggtctgagaaggccaccgcagtcatttcttcccttctgtcagacataattcctcggtttggccttctcacctctatgcagtccgataacggactggcctttattagtcaaatcacccaagcagtttttcaggctcttggtattcagtgaaatctttatatcccttaccgtcctcagtcttcaggaagggtagaatggactaatggtcttttaaaaacacaactcaccaagctcagccaccaacttaaaaaggactggacaatacttttatcacttgcctttctcagaatttgggcctgtccttggaatgctacagggtacagcccatttgagctcctgtatagacgttcctttttattaggccccagtctcattccagacaccataccaacttggactgtaccccaaaaaacttgtcatccctactatcttctgtctggtcatactcatattcaccattctcaactacacataaatgccctgctcttgtttacagtgccggtttacactgtttctccaagccatcacagctgatatctcctggtgctatctccaaaccgccactcttaactccttcttaaagtaaataaataatctttgctggcagggctatgctgaacctccttgggcactctctaattagatgtactgggtcctcccaattcttagtcctttaatacctgtttttctccttctcttattccttttagttttttaattcatgcaaaaccatatccaggccatcaccaatacttctatacaacaaatgtttcttctaacaaccccacaatatcaccccttaccacaaaatcttccttcagcttaatctctcccactctagattcccacgctgcccctaatcccgcttgaagcagccctgagaaacatcacccattctctctccataccaccccccaaaattttcaccgccccaacactttaccactattttgttttatttttcttattaatataaaaagacaggaatgtcagacctctgagcccaagctaagccatcatatcccctgtgacctgcacatacatccagatggcctgaagtaactgaagaatcataaaagaagtgaaaatggcctgttcctgccttaactgatgacattaccttgtgaaattccttctcctggctcatcctggatcaaaagctcccacactgagcaccttgtgacccctacccctgccagctagaaaacaaccccctttgactgtaattttcctttacctacccaaatcctataaaatggccccacccctatctccctttgctgactctcttttcagactcagcccatctgcacccaggtgaaataaacagccctgttgctcacacaaaacctgttgggtggtctcttcacacggatgcgagtgaaa

SEQ ID NO: 769 - DNA, 964 bp, Homo sapiens
gtggggaaaagaaagagatcagattgttactgtgtctgtgtagaaagaagtagacataggagactccattttgttctgtactaagaaaaattcttctgccttgagatgctgttaatctgtaaccttacccccaaccctgtgctccctgaaacatgtgctgtgtcaactcagggttaaatggattaatggcggcgcaaggtgtgctttgttaaacagatgcttgaaggcagcgtgctccttaagagtcatcaccactccctaatctcaagtacccagggacacaaaacactgcagaaggccgcagggacctctgcctaggaaagccaggtgttgtccaaggtttctccccatgtgatagtctgaaatatggcctcgtgggaagggaaagacctgaccgtcccccagcccgacacctgtaaagggtctgtgctgaggaggattagtaaaagaggaaggaacgcctctttgcagttgagacaagaggaaggcatctgtctcctgcccgtccctgggcaatggaatgtctcagtgtaaaacccaattgcatattccctctactgagataggagaaaaccgccttagggctggaggtgggacatgcgggcagcaatactgctctttaaggcattgagatgtttatgtgtatacacatctaaagcacagcacttaattctttaccttgtttatgatgcagagacctttgttcacgtgtttacctgctgactttctctccactattatcctatgaccctgccacattccgctctccaagaaacacccaagaatgatcaataaatactaagggaactcagaggctggcaggatcctccgtaagttgaacgccagtcccctgggcccccttttttctttctcttcactttgtctgtgtctctttcttttccaagtctctcgttccacctaatgagaaacacccacaggtgtggaggggcaacccaccccttca

SEQ ID NO: 770 - DNA, 5767 bp, Homo sapiens
gtcaggcctctgagcccaagccaagccatcgcatctcctgtgacttgcacgtatacgcccagatggcctgaagtaaccgaagaatcacaaaagaagtgaatatggcctgccccaccttaactgatgacattccaccacaaaagaagtgtaaatggccggtccttgccttaagtgatgacattaccttgtgaaagtccttttcctggctcaaaaagcacccgcactgagcaccttgcgacccccactcctgcccgccagagaacaaaccccctttgactgtaattttcctttacctacccaaatcctataaaacggccccacccttatctcccttcgctgactctcttttcggactcagcccgcctgcacccaggtgaaataaacagccatgttgctcacacaaagcctgtttggtggtctcttcacacggacgcgcatgaaatttggtgccatgactcggatcgggggacctcccttgggagatcaatcccctgtcctcctgttctttgctccatgagaaggatccacctacgacctcaggtcctcagaccaaccagcccaagaaacatctcaccaattttaaatcaggtaagcggcctcttcttactctcttctccaacctctctcactgtccctcaaccactttcttctttccactcttcaatctctcccttctctgaatttcaattcctttcattttctgggagagacaaaggagacacatattatctgtcaacccaaaactccggcgccggtcacggactgggaaggcagccttcccttggtgtttaatcattgcaaggacgcctctctgattattcaaccacatttcaaaggtgtcagaccacgcagggatgcctgccttggtacttcacccttagcggcaagtcctgcttttctggggaaggggcaagtaccccaaccccttctctccttgtctctaccccttctctgctttcctggggcaggggcaagtacccctcaaccccttctccttcacccttagaggcaagtcccgcttttctagggggcaagaacccccaatcccttatttccacaccccaaccttgtatctctgcaccccaatcccttatttccgtgccccgaccccttatttccatgccccaaccccttatttctgcaccccatcccttatttccatgccccgacctcttatctctgcgccccaacccctcttcccacttttctggaaggtaagaacccccgaaccccttccctccgtttctctactctctcttttctctaggcttgcttccttcactataggcaaccttccaccctccattcccccttctactcccttggcctgtgttctcaaaaacttaaaacctcttcaactcacacctgacctaaaacctaaatgccttattttcttctgcaatgctgcttgaccccaatacaaactcaacagtagttccaaatagccagaaaatggcactttgaatttttccatcctgcaaggtctaaataattcttgttgcaaaataggcaaatggtctgaggtgcctaatgtccaggcattcttttacacatcagtcccttcctagtctctgtgcccagtgcaactcgtcccaaatcttccttctttccctcccgcctgtcccctcagtcccaaccccaagcgtccctgagtctttctaatcttccttttctacagactcatctgacctctcccctcctcgccaggccaagctaggtcccaattcttcctcagcctccgctcctccaccctataatttttttattgcctcccctcctcacacctggtcaagcttacagtgtcctctgtgactagccctcccccacccgcccagcaatttactcttaaaaaggtagctggagctaaaggcttaatcaaggttaatgctcctttttctttatcccaaatcagatggcgtttaggctctttttcatcaaatataaaaatccagcccagttcatgactcgtttggcagcaaccctgagacactttacagccctagaccctaaaaggtcaaaaggccgtcttattctcaaaatacattttattacccaatctgctcccgacattaaataaaactccaaaaattaaattccagccctcaaaccccacaacaggatttaattaacctcgccttcaaggtgtacaataatagaaaaaagttgcaattccttgcctccactgtgagacaaaccccagccacatctccagcacacaagaacttccaaatgcctgaaccgcagcggccaggcgttcctccagaacctcctcccacaggagcttgctacatgtgccagaaatctggccactgggccaaggaatgcccacagcccgggattcctcctaagccacgtcccatctgtgtgggaccccactgaaaatcagactgttcaactcacctggcagccactcccagagcccctggaactctggcccaaggctctctgactgactccttcccagatcttcttggcttagcggctgaagactgacacagcccgatcgcctcggaagccccatagaccatcatggacgccgagcttccggtaactctcacagtggaaggtaaggccgtccccttcttaatcaatacggaggctacccactccacattaccttcttttcaagggcctgtttcccttgcctccataactgttgtgggtattgatggccaggcttctaaacctcttagaactccccacctctggtgccaacttagacaatactcttttaagcactcctttttagttatccccacctgcccagttcccttattaggctgagacactttaactaaattatctgcttccctgactattcctggactacagctatatctcattgccgcccttcttcccaatccaaagcctcctttgcgtcctcctcttgtatccccccaccttaacccacaagtataagatacctctactccctccttggcaaccgatcatgcaccccttaccatctcattaaaacctaatcacccttaccccactcaacgccaatatcccatcccgcagcacactttaaaaagattaaagcctgttatcactcgcctgctacagcatggccttttaaagcctataaactctccttacaattcccccattttacgtgtcctaaaaccagacaagccttactagttcaggatctgcgccttatcaaccaaattgttttgcctatccaccccatggtgccaaacccatatactctcctatcctcagtacctgcctctataacccattattctgttctagatctcaaacatgctttctttactattcctttgcacccttaatcccagcctctcctcactttcacctggactgaccctgacacccatcaagctcagcaaattacctaggctttactgctgcaaagcttcacagacagcccccattacttcaatcaagcccaaatttcttcctcatctgttacctatctcggcataattctcataaaaacacacgtgctctccctgccaatcgtgtccgactgatctctcaaaccccagcaccttctacaaaacaacaactcctttccttcctaggcatggttagcgtagtcagaattcttacacaagagccaggaccacaccctgtagcctttctgtccaaacaacttgaccttactgtttcagcctagccctcatgtctgcgtgcagcggctgctgctgcattaatacttttagaggccctcaaaatcacaaactatactcaactcactctctacagttctcataacttccaaaatctattttcttcctcatacctgacgcatatactttctgctccccggctccttcagctgtactcactcttcgttgagtctcccgcaattaccattgttcctggcccggacttcaatccggcctcccacattattcctgataccacacctgacccccatgactgtatctctctgatccacctgacattcaccccatttccccacatttccttctttcctgttcctcaccctgatcacgcttgatttattgatggcggttccaccaggcctaatcgccacacaccagcaaaggcaggttatgctatagtacaagccactagcccgcctcttagaacctctcatttcctttccgtcgtggaaatctatcctcaaggaaataacttctcagtgttccatctgctattctactactcctcagggattattcaggccccctcccttccctacacatcaagctcgaggatttgccccacctaggactggcaaattagctttactcaacatgcccggagtcagataattaaaatacctcttagtctaggtagatactttcactggataggtagaagcctttcctacagggtctgagaaggccaccacagtcatttcttcccttctgtcagacataattcctcagtttagccttcccacctcaatacagtctgataaaagacgagcctttattagtcaaatcagccaagcagtttttcaggctcttagtattcagtgaaacctttatatcccttacagtcctccgtcttcaaggaaagtagaatggactaaaggtcttttaaaaacacacctcacaagctcagccaccaatttaaaaaggactggacaatacttttaccactttcccttctcagaattcaggcctgtcctcggaatgctacagagtacagcccatttgagctcctgtatagacgctcctttttattaggccccagtctcattccagacaccagaccaacttagactgtgccccaaaaaaacttgtcatccctactatcttctgtctagtcatactcctattcaccgttctcaactactcatacatgccctgctcttgtttacactgccggtttacactgtttttccaagccatcacagctgatatctcctggtgctatccccaaactgccactcttaactcttgaagtaaataaataatctttgctggcaggactatgctgaatctccttaggcactctctaatcagatatcctgagtcatcccaattcttagaccttttatacctgtttttctccttctgttattccatttagtttctcaattcatccaaaaccgtatccagcccatcaccaatcattctatatgacaaatgtttcttctaacatccccacaatatcaccccttaccacaagacctcccttcagcttaatctctcccactctaggttcccacgccgccccaatccctctcgaagctgccctgaaaaacatcgcccattctctctccataccaccccccaaaaatgttcgccgccccaacacttcaacaccattttgttttatttttcttattaatataagaaggcaggaatgtcaggcctctgagcccaagccaagccatcgcatctcctgtgacttgcacgtatatgcccagatggcctgaagtaaccgaagaatcacaaaagaagtgaaaatgccctgccccaccttaactgatgacattccaccacaaaagaagtgtaaatggccggtccttgccttaagtgatgacattaccttgtgaaagtccttctcctggctcatcctggctcaaaaatcacccccactgagcaccttgcgacccccactcctgcccgccagagaacaaaccccctttgactgtaattttcctttacctacccaaatcctataaaacggccccacccttatctcccttcgctgactctcttttcagactcagcccgcctgcacccaggtgaaataaacagccatgttgctcacacaaagcctgtttggtggtctcttcacacggacgcgcatgaaa

SEQ ID NO: 771 - DNA, 1022 bp, Homo sapiens
taggtagctagtcagacatgagcaggccaggagagggcccaatcccacccccaccaggaatgtcgggtgactatcaggtggtggtcaggtggttgttaactgtctctctaaaaaaataattggtcacacccagtgccagggaaaggtagtctcccaatagatagaaaaaacctgaagttggtgatcagcgacttcctactaatatctcaggagccgggtaagtgggctcacatgtgtgcaccaagacgaaaactggcggagtttaactggtatgtgaccttatacgaagacttgactggtaaaggaagaacatctcaagtgagcatgtgtacaagtcccataaatgcactgtgcatgctcacctccaagagctggcaggccactgcacatgcagacagcccaccccaagggaagaatcagagagaagggatgcaaggccccagaagtgtgccaacatataaaaccctaggtcaaaggtcaaagcatgcacttgatctctcaagttgcccgcttggccccctcttccaagtgtactttacttcctttcattcctgccctaaaactttttaataaactctcactcctgctctaaaacttgcctcagttctctcttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccacctcagttctcactctgccttatgcccccctcagctgaattctttcttctgaggaggcaggaattgaggttgctacagatccatacagatt

SEQ ID NO: 772 - DNA, 403 bp, Homo sapiens
gtcaggcctatgagcccaagctaagccatcatatcccctgtgacctgcacgtacacatccagatggccggttcctgccttaactgatgacattccaccacaaaagaaatgaaaatggcctgttcctgccttaactgatgacattatcttgtgaaattccttctcctggctcatcctggctcaaaagctcccctactgagcaccttgtgacccccactcttgcctgccagagaacaacccccgtttttcctttacctacccaaatcctataaaacggccccacccctacctcgcctcgctgactctcttttcggactcagcccgcctgtacccaggtgaaataaacagccttgctgctcacacaaagcctgtttggtggtctcttcacacggacgcgcatgaaa

SEQ ID NO: 773 - DNA, 578 bp, Homo sapiens
tcaggcctctgagcctaagctaagccatcgcatcccctgtgacctgcacgtatacgcccagatggcctgaagtaactgaagaatcacaaaagaagtgaaaatggcctgttcctgccttaactgatgacattccaccacaaaagaagtgaaaatgtcctctcctggccttaactgatgacattaccttgtgaaattccttttcctggctcatcctggctcaaagaagctcctccactaagcaccttgtgacccccactcctgccagccagagaataactcccctttgactgtaattttcctttacctacccaaatcttataaaacggccccacccctgtctcccttcactgactctcttttcggactcagcacgcctgcacccaggtgaaataaagatgagttagtgcgtgcagtgcaccagcatgtcacatgtatacatatgtaactaacctgcacattgtgcacatgtaccctaaaacttaaagtataataataaaaaaaaaaaagaaaagaaataaacagccttgttgctcacacaaaggctgtttggtggtctcttcacatgcacgcgagtgaaa

SEQ ID NO: 774 - DNA, 67 bp, Homo sapiens
tacaataggtagttagacatgagcagcgcaggagagccccccacctccccaccccaccaggaatgcc

SEQ ID NO: 775 - DNA, 1025 bp, Homo sapiens
aaagaaagaaaagaaacaatgttttgtagggaaaagaaagagagttcagactgttactgtgtctatgtagaaaaggaagacataagaaactccattttgatctgtaccctgaacaattgttttgccctgagatgccgttaatttgtaactttagccccaaccttgagctcacagaaacatgtgttgtatggaatcaaggtttaaggatctagggctgtgcaggatgtgccttgttaacaatatgtttacaggcagtatgcttggtaaaagtcatcgccattctccattctccattaaccgggggcacaatgcactgcggaaagccgcagggacctctgcccacgaaaacctgggtattgtccaaggtttctccccattgagagaggctgagatatggcctcatgggaagggaaagacctgaccatccctcagcccaacacccgtaaagtgtctctgctgaggaggattagtaaaagaggaaggcctcttgcggttgagataagaggaaggcctctgtctcctgcatgcccctgggaacggaatgtctcggtataaaacctgattgtacattcgttctatactgagatagaagaaaaccaccctgtgtctggaggcgagatatgctggtgataattctgctctgttactctttactacactgagatgtttgggtggagggaagcataaatctggcctacatgcacatccaggcacagtcccttcccttgaacttatttgtgacacagattcctttgctcacatgttttttttgctgaccatctccccactatcaccctgttctcctgccgcattccccttgctgagatagtgaacatagtaatcaataaatactgagggaactcagagaccggggctggggtgggtcttccatatgctgagcgctggtctcctgggcccactgttctttccctatactttgtctctgtgtcttatttcttttctcagtctctcttcccacctgatgagaaatacccgcaggtgtggaggagcaggccacctcttca

The invention claimed is:

1. A method for detecting an RNA transcript, comprising:
obtaining a biological sample that is collected from a human patient suspected of having testicular cancer; and
detecting, in the biological sample, the presence or absence of an RNA transcript expressed by a nucleic acid sequence having at least 99% identity with SEQ ID NO: 1.

2. The method as claimed in claim 1, further comprising detecting, in the biological sample, the presence or absence of a second RNA transcript expressed by a second nucleic acid sequence having at least 99% identity with SEQ ID NO: 2, 3, 4, 5, 7, 8, 9, 10, 11, 12, 13, 14, 15, 16, 17, 18, 19, 20, 21, 23, 24, 25, 26, 27, 29, 31, 32, 33, 34, 36, 38, 39, 40, 41, 42, 43, 44, 45, 46, 47, 50, 51, 52, 53, 57, 58, 59, 61, 63, 64, 65, 68, 70, 71, 72, 74, 75, 76, 77, 78, 79, 80, 83, 84, 85, 86, 87, 88, 89, 90, 91, 92, 94, 96, 97, 102, 104, 106, 107, 109, 110, 115, 116, 118, 121, 122, 123, 127, 132, 133, 136, 137, 142, 147, 148, 150, 159, 160, 162, 163, 164, 165, 166, 167, 170, 171, 175, 182, 187, 191, 198, 199, 201, 207, 210, 216, 219, 222, 224, 228, 230, 234, 244, 256, 263, 265, 266, 269, 271, 281, 286, 288, 291, 292, 296, 298, 304, 308, 333, 341, 347, 403, 429, 452, 485, 513, 556, 574, or 755.

3. The method as claimed in claim 2, wherein the second nucleic acid sequence has at least 99% identity with SEQ ID NO: 26 or 29.

4. The method as claimed in claim 1, wherein the RNA transcript is an mRNA transcript.

5. The method as claimed in claim 1, wherein the RNA transcript is detected by hybridization, amplification, or sequencing.

6. The method as claimed in claim 4, wherein the mRNA transcript is detected by bringing the mRNA transcript into contact with a probe and/or a primer, and detecting the presence or absence of hybridization to the mRNA transcript.

7. The method as claimed in claim 4, wherein the mRNA transcript is detected by detecting the presence or absence of cDNA obtained from the mRNA transcript.

8. A method for detecting an RNA transcript, comprising:
obtaining a biological sample that is collected from a human patient that has been diagnosed with testicular cancer; and
detecting, in the biological sample, the presence or absence of an RNA transcript expressed by a nucleic acid sequence having at least 99% identity with SEQ ID NO: 1.

9. The method as claimed in claim 8, further comprising detecting, in the biological sample, the presence or absence of a second RNA transcript expressed by a second nucleic acid sequence having at least 99% identity with SEQ ID NO: 2, 3, 4, 5, 7, 8, 9, 10, 11, 12, 13, 14, 15, 16, 17, 18, 19, 20, 21, 23, 24, 25, 26, 27, 29, 31, 32, 33, 34, 36, 38, 39, 40, 41, 42, 43, 44, 45, 46, 47, 50, 51, 52, 53, 57, 58, 59, 61, 63, 64, 65, 68, 70, 71, 72, 74, 75, 76, 77, 78, 79, 80, 83, 84, 85, 86, 87, 88, 89, 90, 91, 92, 94, 96, 97, 102, 104, 106, 107, 109, 110, 115, 116, 118, 121, 122, 123, 127, 132, 133, 136, 137, 142, 147, 148, 150, 159, 160, 162, 163, 164, 165, 166, 167, 170, 171, 175, 182, 187, 191, 198, 199, 201, 207, 210, 216, 219, 222, 224, 228, 230, 234, 244, 256, 263, 265, 266, 269, 271, 281, 286, 288, 291, 292, 296, 298, 304, 308, 333, 341, 347, 403, 429, 452, 485, 513, 556, 574, or 755.

10. The method as claimed in claim 9, wherein the second nucleic acid sequence has at least 99% identity with SEQ ID NO: 26 or 29.

11. The method according to claim 2, further comprising detecting, in the biological sample, the presence or absence of a third RNA transcript expressed by a third nucleic acid sequence having at least 99% identity with SEQ ID NO: 6, 22, 28, 30, 35, 37, 48, 49, 54, 55, 56, 60, 62, 66, 67, 69, 73, 81, 82, 93, 95, 98, 99, 100, 101, 103, 105, 108, 111, 112, 113, 114, 117, 119, 120, 124, 125, 126, 128, 129, 130, 131, 134, 135, 138, 139, 140, 141, 143, 144, 145, 146, 149, 151, 152, 153, 154, 155, 156, 157, 158, 161, 168, 169, 172, 173, 174, 176, 177, 178, 179, 180, 181, 183, 184, 185, 186, 188, 189, 190, 192, 193, 194, 195, 196, 197, 200, 202, 203, 204, 205, 206, 208, 209, 211, 212, 213, 214, 215, 217, 218, 220, 221, 223, 225, 226, 227, 229, 231, 232, 233, 235, 236, 237, 238, 239, 240, 241, 242, 243, 245, 246, 247, 248, 249, 250, 251, 252, 253, 254, 255, 257, 258, 259, 260, 261, 262, 264, 267, 268, 270, 272, 273, 274, 275, 276, 277, 278, 279, 280, 282, 283, 284, 285, 287, 289, 290, 293, 294, 295, 297, 299, 300, 301, 302, 303, 305, 306, 307, 309, 310, 311, 312, 313, 314, 315, 316, 317, 318, 319, 320, 321, 322, 323, 324, 325, 326, 327, 328, 329, 330, 331, 332, 334, 335, 336, 337, 338, 339, 340, 342, 343, 344, 345, 346, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 404, 405, 406, 407, 408, 409, 410, 411, 412, 413, 414, 415, 416, 417, 418, 419, 420, 421, 422, 423, 424, 425, 426, 427, 428, 430, 431, 432, 433, 434, 435, 436, 437, 438, 439, 440, 441, 442, 443, 444, 445, 446, 447, 448, 449, 450, 451, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 486, 487, 488, 489, 490, 491, 492, 493, 494, 495, 496, 497, 498, 499, 500, 501, 502, 503, 504, 505, 506, 507, 508, 509, 510, 511, 512, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 557, 558, 559, 560, 561, 562, 563, 564, 565, 566, 567, 568, 569, 570, 571, 572, 573, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 698, 699, 700, 701, 702, 703, 704, 705, 706, 707, 708, 709, 710, 711, 712, 713, 714, 715, 716, 717, 718, 719, 720, 721, 722, 723, 724, 725, 726, 727, 728, 729, 730, 731, 732, 733, 734, 735, 736, 737, 738, 739, 740, 741, 742, 743, 744, 745, 746, 747, 748, 749, 750, 751, 752, 753, 754, 756, 757, 758, 759, 760, 761, 762, 763, 764, 765, 766, 767, 768, 769, 770, 771, 772, 773, 774, or 775.

12. The method according to claim 7, wherein the presence or absence of the cDNA is detected by bringing the cDNA into contact with a probe and/or a primer, and detecting the presence or absence of hybridization to the cDNA.

13. The method according to claim 1, wherein the RNA transcript is expressed by the nucleic acid sequence of SEQ ID NO: 1.

14. The method as claimed in claim 13, wherein
the RNA transcript is a mRNA transcript, and
the mRNA transcript is detected by detecting the presence or absence of cDNA obtained from the mRNA transcript.

15. The method as claimed in claim 13, further comprising determining an expression level of the RNA transcript in the biological sample.

16. The method as claimed in claim 13, wherein
the RNA transcript is a mRNA transcript, and
the mRNA transcript is detected by bringing the mRNA transcript into contact with a probe and/or a primer, and detecting the presence or absence of hybridization to the mRNA transcript.

17. The method as claimed in claim 1, further comprising determining an expression level of the RNA transcript in the biological sample.

18. A method for detecting an RNA transcript, comprising:
obtaining a biological sample that is collected from a human patient suspected of having testicular cancer;
detecting, in the biological sample, the presence or absence of an RNA transcript expressed by a nucleic acid sequence having at least 99% identity with SEQ ID NO: 1 by contacting the RNA transcript or cDNA obtained therefrom with a probe or primers to respectively hybridize to or amplify a region within the RNA transcript or cDNA obtained therefrom that is defined by a distinct region within the nucleic acid sequence.

19. The method as claimed in claim 1, wherein no more than 775 specific binding partners are used to detect the RNA transcript.

* * * * *